US010150965B2

(12) United States Patent
Brown et al.

(10) Patent No.: US 10,150,965 B2
(45) Date of Patent: Dec. 11, 2018

(54) METHODS AND COMPOSITIONS FOR THE SPECIFIC INHIBITION OF TRANSTHYRETIN (TTR) BY DOUBLE-STRANDED RNA

(71) Applicant: Dicerna Pharmaceuticals, Inc., Cambridge, MA (US)

(72) Inventors: Bob D. Brown, Littleton, MA (US); Henryk T. Dudek, Wellesley, MA (US)

(73) Assignee: Dicerna Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 15/102,181

(22) PCT Filed: Dec. 5, 2014

(86) PCT No.: PCT/US2014/068764
§ 371 (c)(1),
(2) Date: Jun. 6, 2016

(87) PCT Pub. No.: WO2015/085158
PCT Pub. Date: Jun. 11, 2015

(65) Prior Publication Data
US 2016/0304870 A1    Oct. 20, 2016

Related U.S. Application Data

(60) Provisional application No. 61/912,891, filed on Dec. 6, 2013.

(51) Int. Cl.
*C12N 15/113* (2010.01)
*A61K 31/713* (2006.01)
*C12Q 1/6883* (2018.01)

(52) U.S. Cl.
CPC .......... *C12N 15/113* (2013.01); *A61K 31/713* (2013.01); *C12N 15/1138* (2013.01); *C12Q 1/6883* (2013.01); *C12N 2310/14* (2013.01); *C12N 2310/315* (2013.01); *C12N 2310/321* (2013.01); *C12Q 2600/178* (2013.01)

(58) Field of Classification Search
None
See application file for complete search history.

(56) References Cited

U.S. PATENT DOCUMENTS

| | | | |
|---|---|---|---|
| 8,349,809 B2 | 1/2013 | Brown | |
| 8,513,207 B2 | 8/2013 | Brown | |
| 2005/0244858 A1 | 11/2005 | Rossi et al. | |
| 2005/0244869 A1* | 11/2005 | Brown-Driver | C12N 15/113 435/6.13 |
| 2005/0277610 A1 | 12/2005 | Rossi et al. | |
| 2007/0265220 A1 | 11/2007 | Rossi et al. | |
| 2013/0210891 A1* | 8/2013 | Yokota | A61K 9/0031 514/44 A |
| 2013/0281510 A1 | 10/2013 | Ando et al. | |
| 2014/0242692 A1* | 8/2014 | Rubin | C12N 15/85 435/348 |

FOREIGN PATENT DOCUMENTS

| | | | |
|---|---|---|---|
| WO | 2010-048228 A2 | 4/2010 | |
| WO | WO 2010048228 A2 * | 4/2010 | ........... C12N 15/111 |
| WO | WO 2011/005860 A2 | 1/2011 | |
| WO | 2011-056883 A1 | 5/2011 | |
| WO | WO 2012/03724 A1 | 3/2012 | |
| WO | WO 2013/075035 A1 | 5/2013 | |

OTHER PUBLICATIONS

Rozema et al, Dynamic PolyConjugates for targeted in vivo delivery of siRNA to hepatocytes, 2007, PNAS, vol. 104, No. 32: 12982-12987.*
Andrade C. A peculiar form of peripheral neuropathy; familiar atypical generalized amyloidosis with special involvement of the peripheral nerves. Brain. Sep. 1952;75(3):408-27.
Coelho T. Familial amyloid polyneuropathy: new developments in genetics and treatment. Curr Opin Neurol. Oct. 1996;9(5):355-9.
Colon et al., Partial denaturation of transthyretin is sufficient for amyloid fibril formation in vitro. Biochemistry. Sep. 15, 1992;31(36):8654-60.
Hammarström et al., Prevention of transthyretin amyloid disease by changing protein misfolding energetics. Science. Jan. 31, 2003;299(5607):713-6.
Jacobson et al., Variant-sequence transthyretin (isoleucine 122) in late-onset cardiac amyloidosis; in black Americans. N Engl J Med. Feb. 13, 1997;336(7):466-73.
Jiang et al., An engineered transthyretin monomer that is nonamyloidogenic, unless it is; partially denatured. Biochemistry. Sep. 25, 2001;40(38):11442-52.
Lai et al., The acid-mediated denaturation pathway of transthyretin yields a conformational intermediate that can self-assemble into amyloid. Biochemistry. May 21, 1996;35(20):6470-82.
Saraiva MJ. Transthyretin mutations in health and disease. Hum Mutat. 1995;5(3):191-6.
Sekijima et al., The biological and chemical basis for tissue-selective amyloid disease. Cell. Apr. 8, 2005;121(1):73-85.
Westermark et al., Fibril in senile systemic amyloidosis is derived from normal transthyretin. Proc Natl Acad Sci U S A. Apr. 1990;87(7):2843-5.
NCBI, GenBank Accessions No. NM_000371.3, "*Homo sapiens* transthyretin (TTR), mRNA", Jan. 22, 2009.
Aaron, Bouchie, "Companies in footrace to deliver RNAi", Nature Biotechnology, Dec. 7, 2012, vol. 30, No. 12, pp. 1154-1157.

(Continued)

*Primary Examiner* — Ekaterina Poliakova-Georgantas
(74) *Attorney, Agent, or Firm* — Wolf, Greenfield & Sacks, P.C.

(57) ABSTRACT

This invention relates to compounds, compositions, and methods useful for reducing transthyretin (TTR) target RNA and protein levels via use of dsRNAs, e.g., Dicer substrate siRNA (DsiRNA) agents.

24 Claims, 36 Drawing Sheets

Specification includes a Sequence Listing.

(56) References Cited

OTHER PUBLICATIONS

Broderick, J.A., et al., "MicroRNA Therapeutics", Gene Therapy, Apr. 28, 2011, vol. 18, pp. 1104-1110.
Garret, R. Rettib, et al., "Progress toward in vivo use of siRNAs-II", Molecular Therapy, Dec. 20, 2011, vol. 20, No. 3, pp. 483-512.
Alleman, Lourdes M., et al., "Comparison of siRNA-induced off-target RNA and protein effects", RNA, Mar. 2007, vol. 13, No. 3, pp. 385-395.
Dore-Savard et al., Central delivery of Dicer-substrate siRNA: a direct application for pain research. Mol Ther. Jul. 2008;16(7):1331-9. doi:10.1038/mt.2008.98. Epub Jun. 3, 2008.
Zhou et al., Deep Sequencing Analyses of DsiRNAs Reveal the Influence of 3' Terminal Overhangs on Dicing Polarity, Strand Selectivity, and RNA Editing of siRNAs. Mol Ther Nucleic Acids. Apr. 3, 2012;1:e17. doi: 10.1038/mtna.2012.6.

* cited by examiner

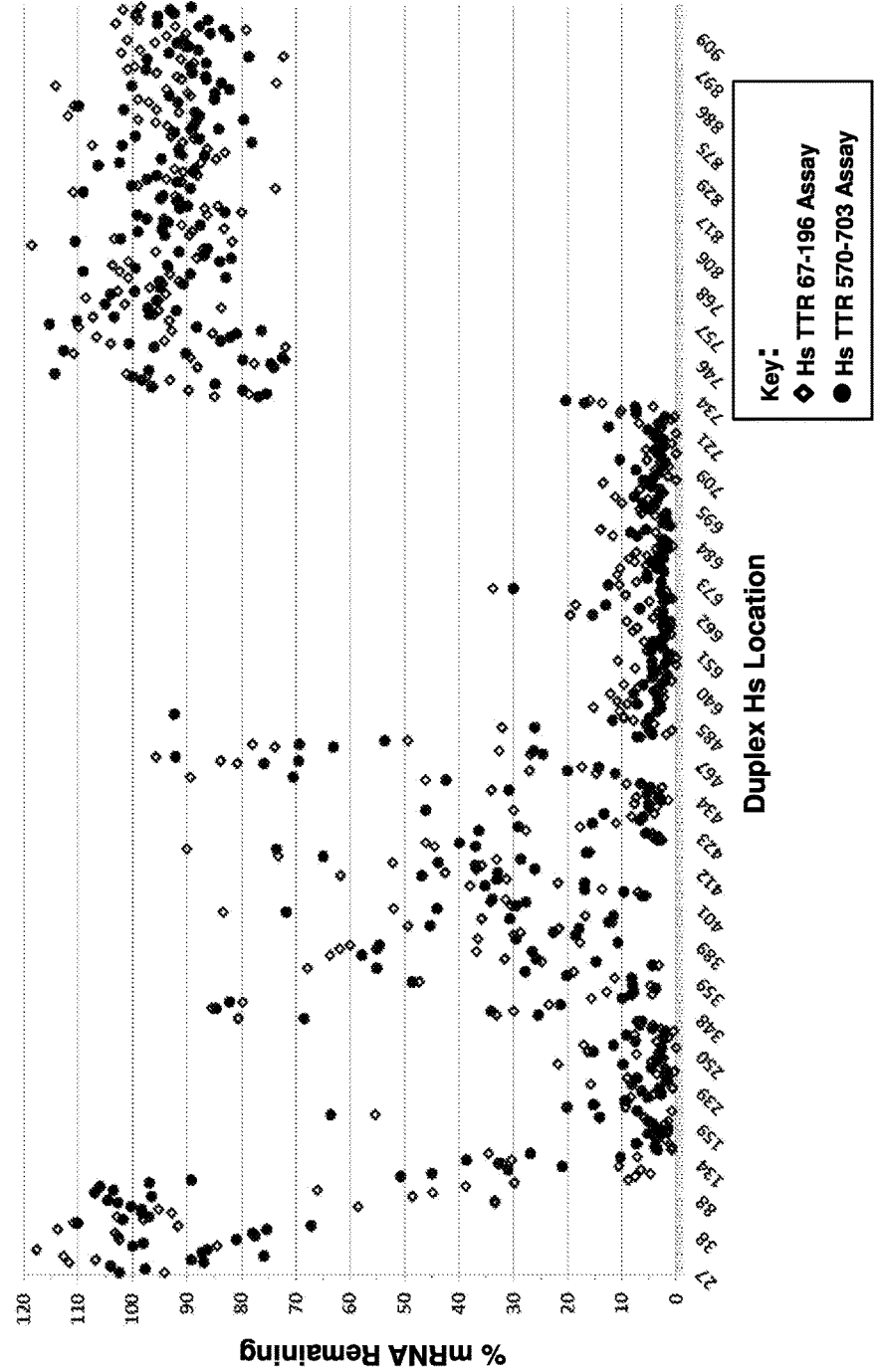

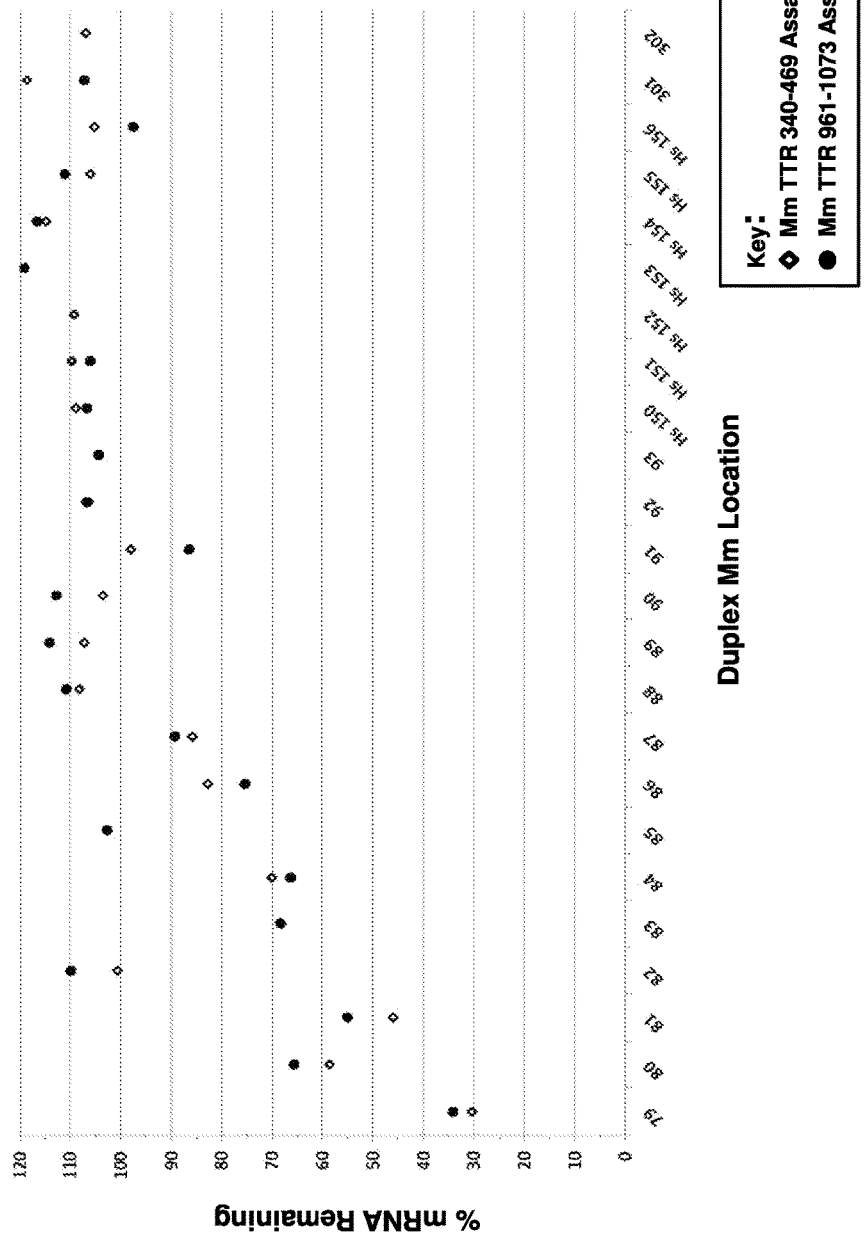

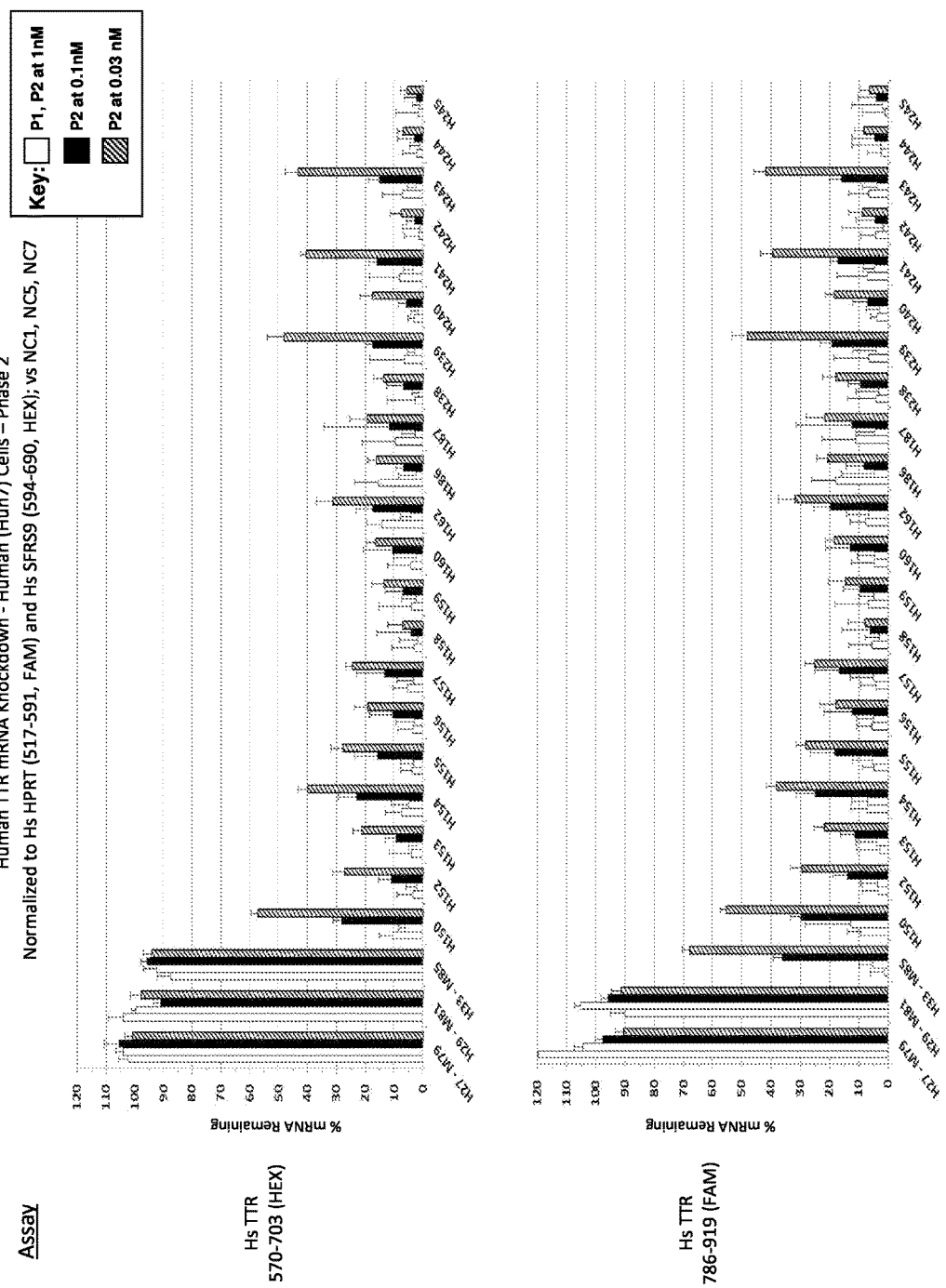

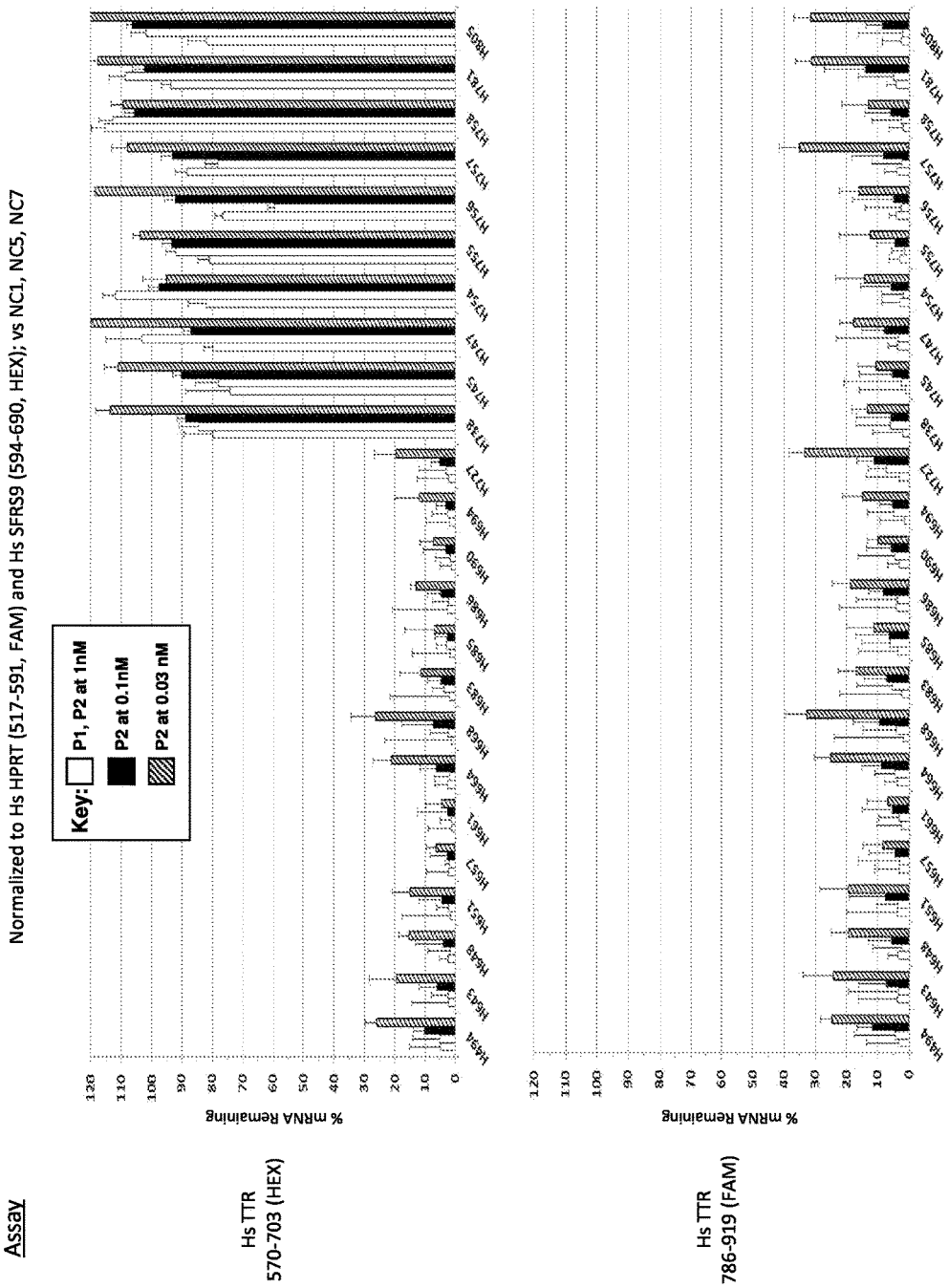

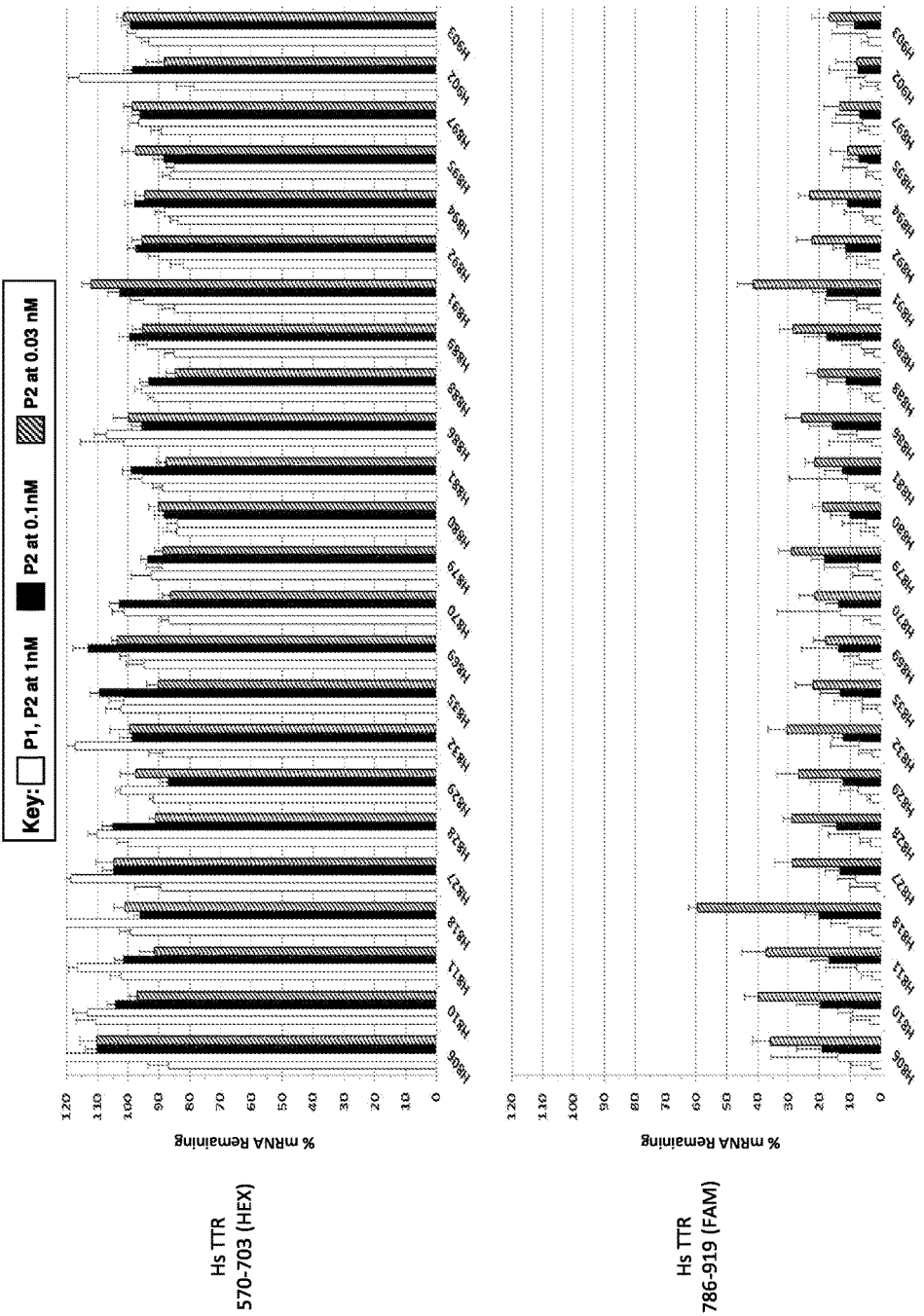

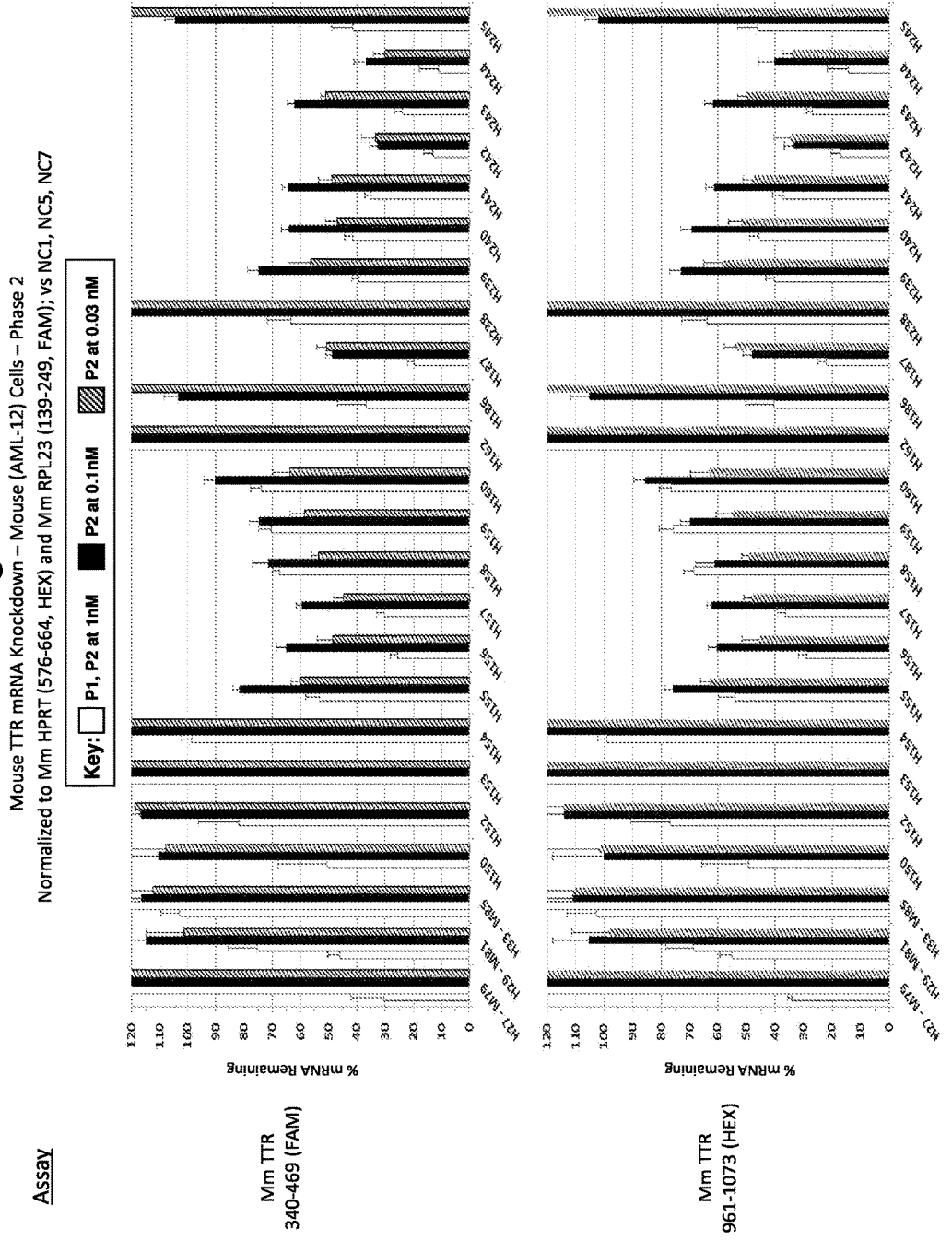

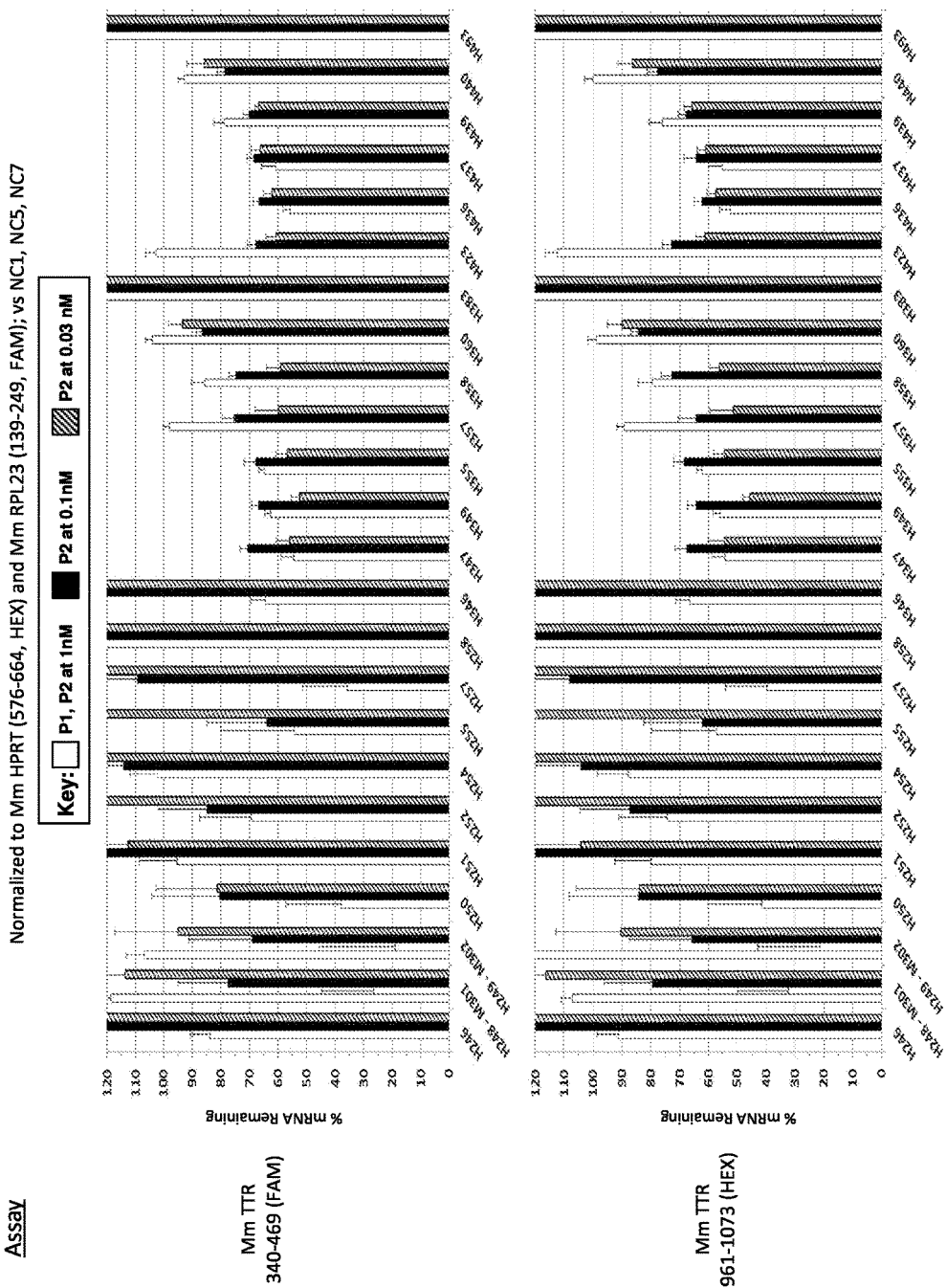

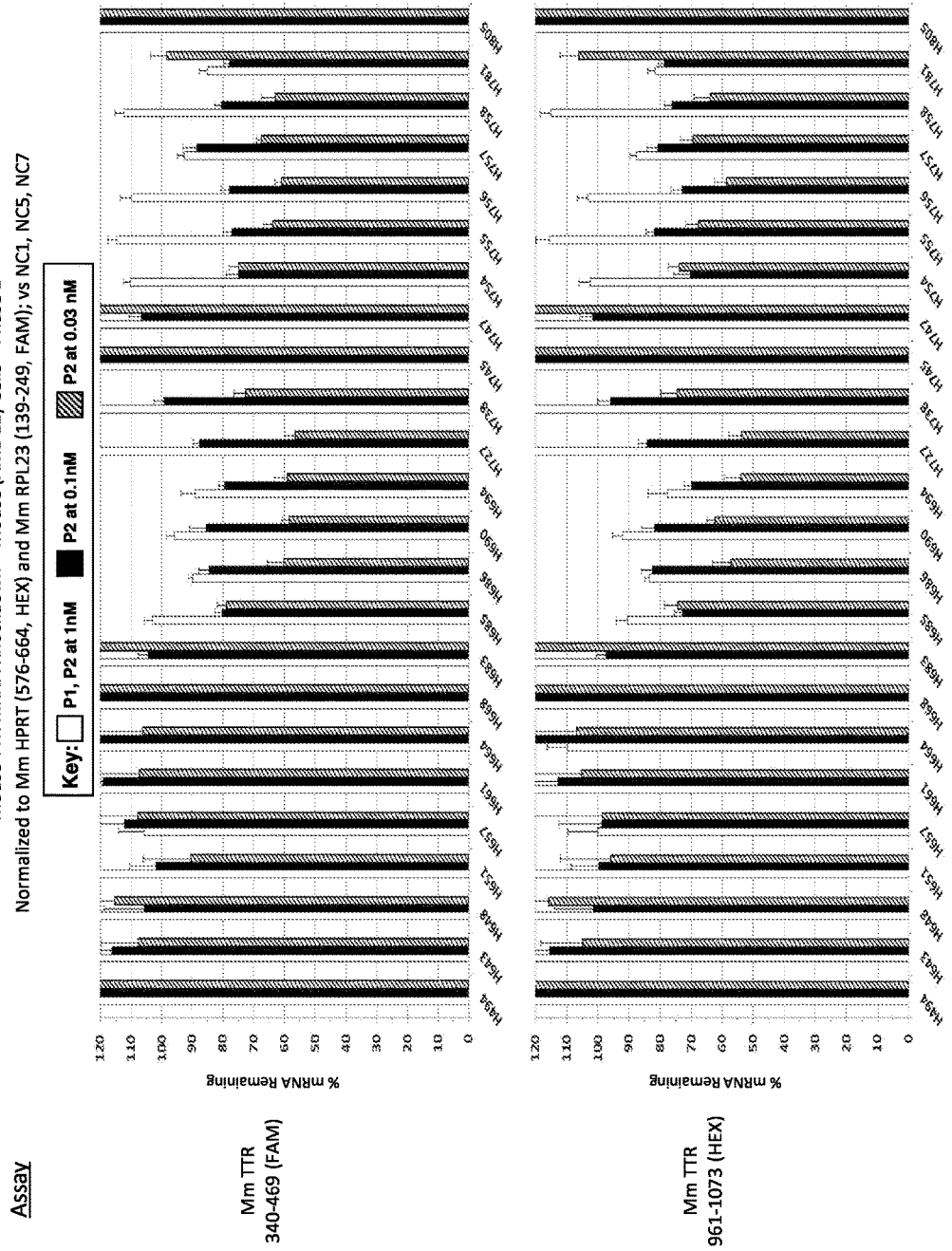

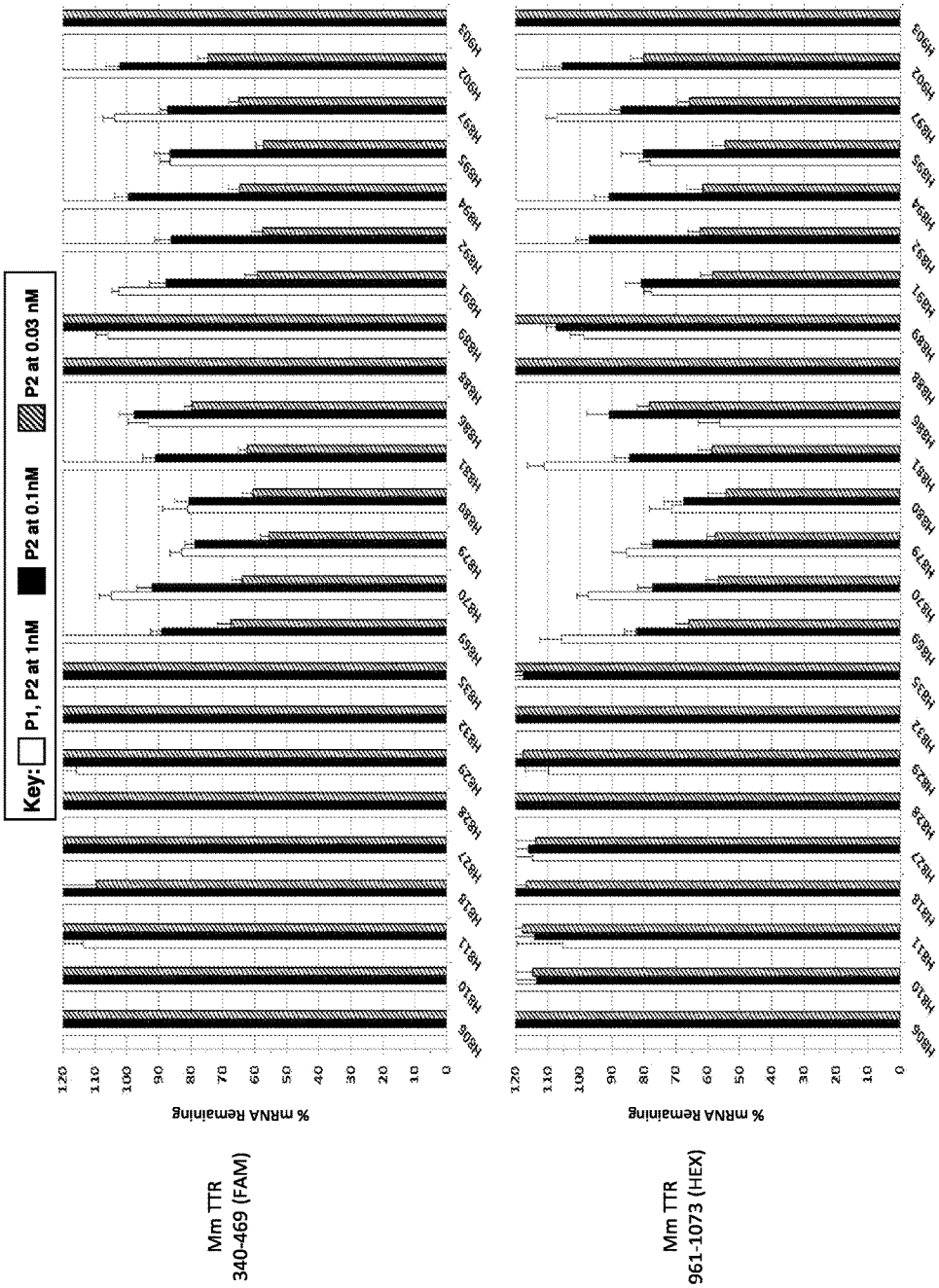

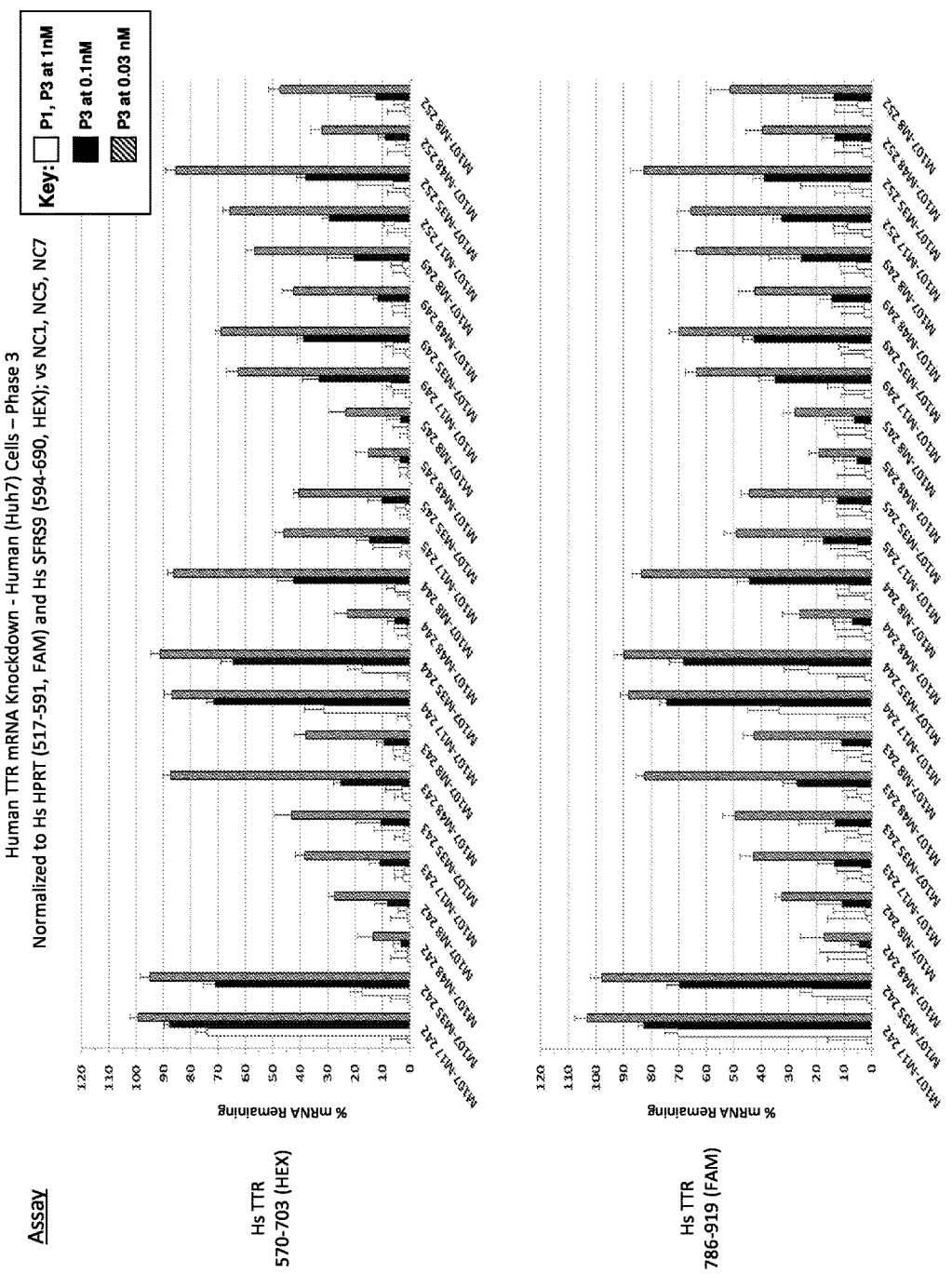

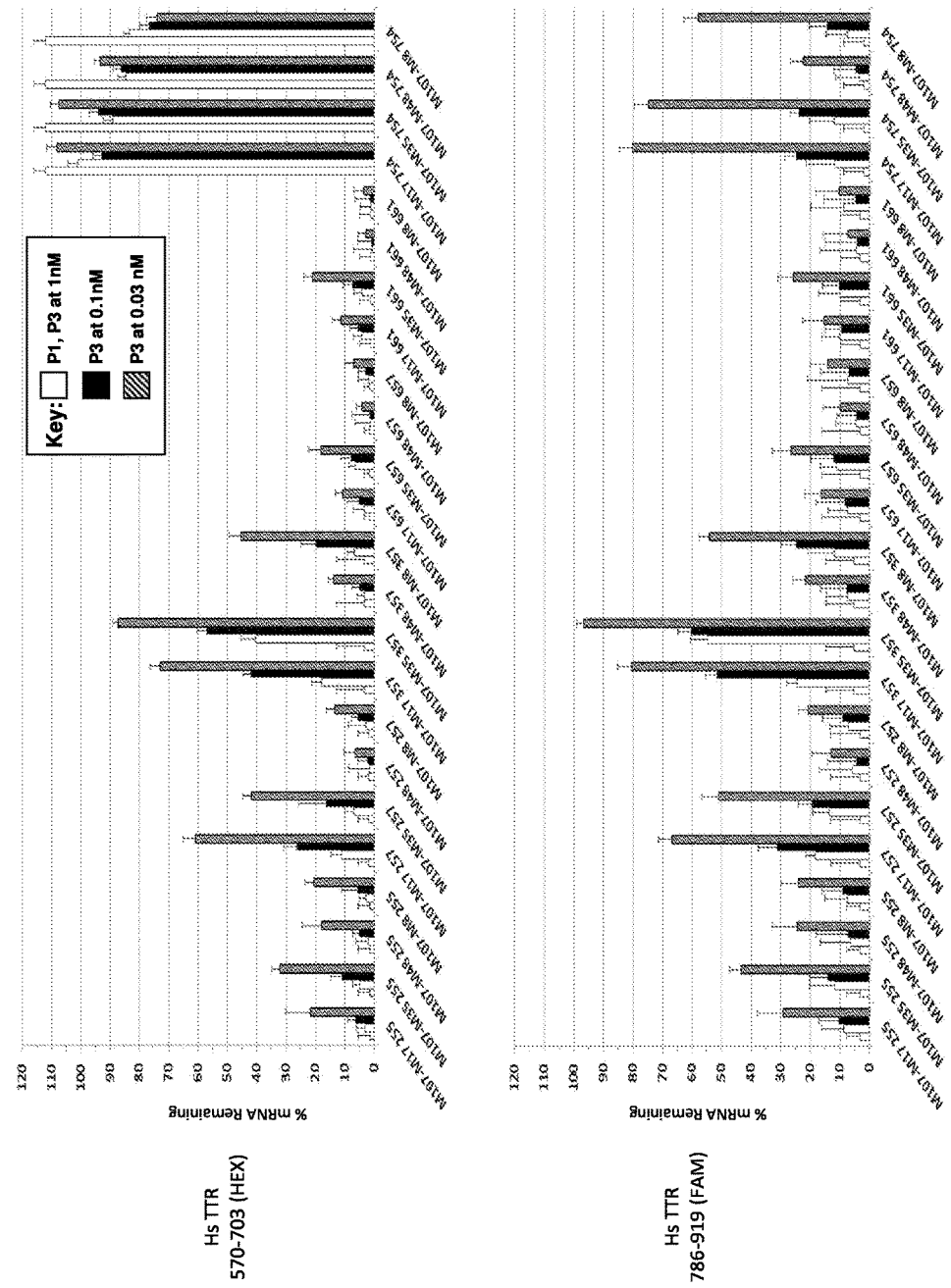

Human TTR mRNA Knockdown - Human (Huh7) Cells – Phase 3
Normalized to Hs HPRT (517-591, FAM) and Hs SFRS9 (594-690, HEX); vs NC1, NC5, NC7

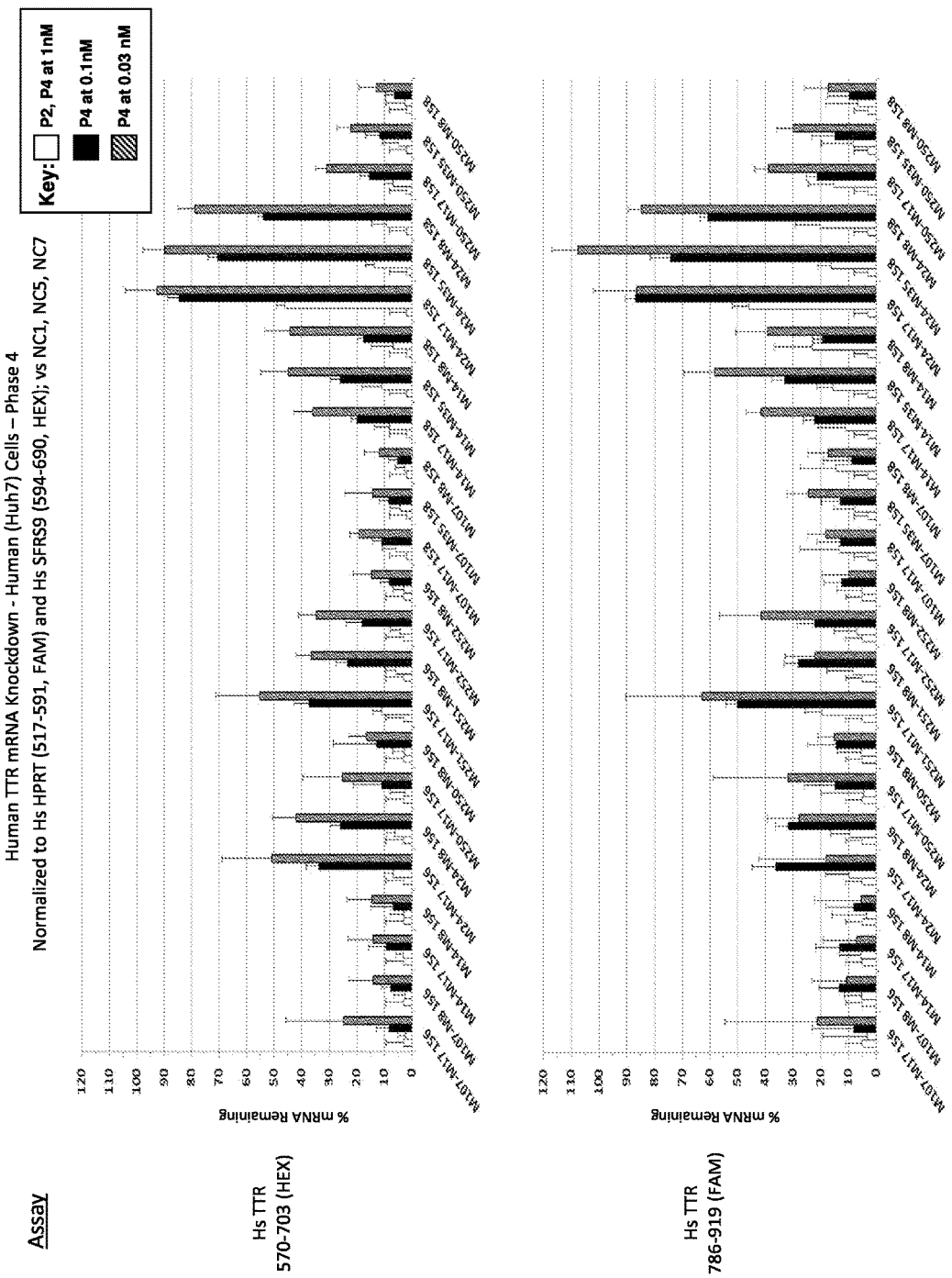

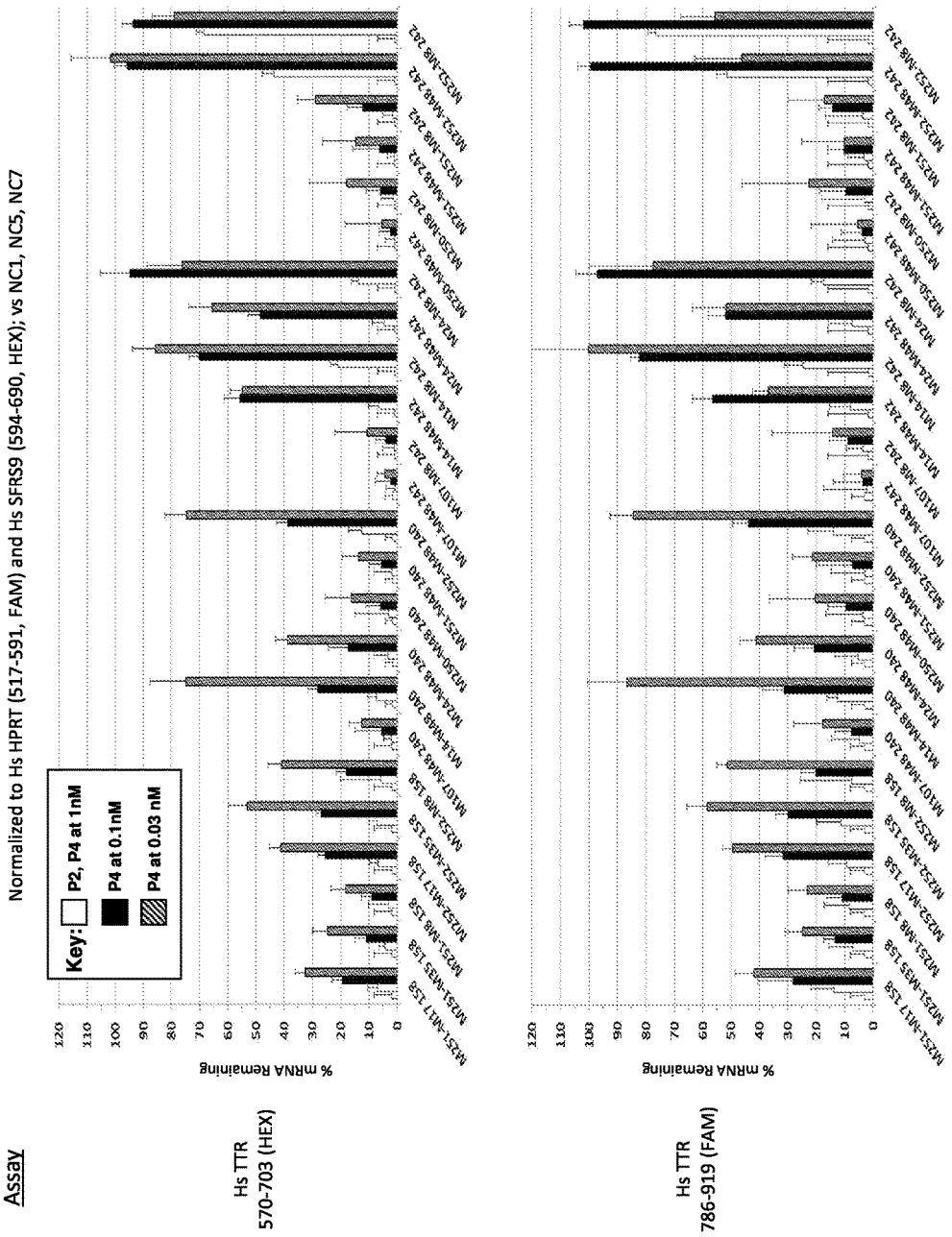

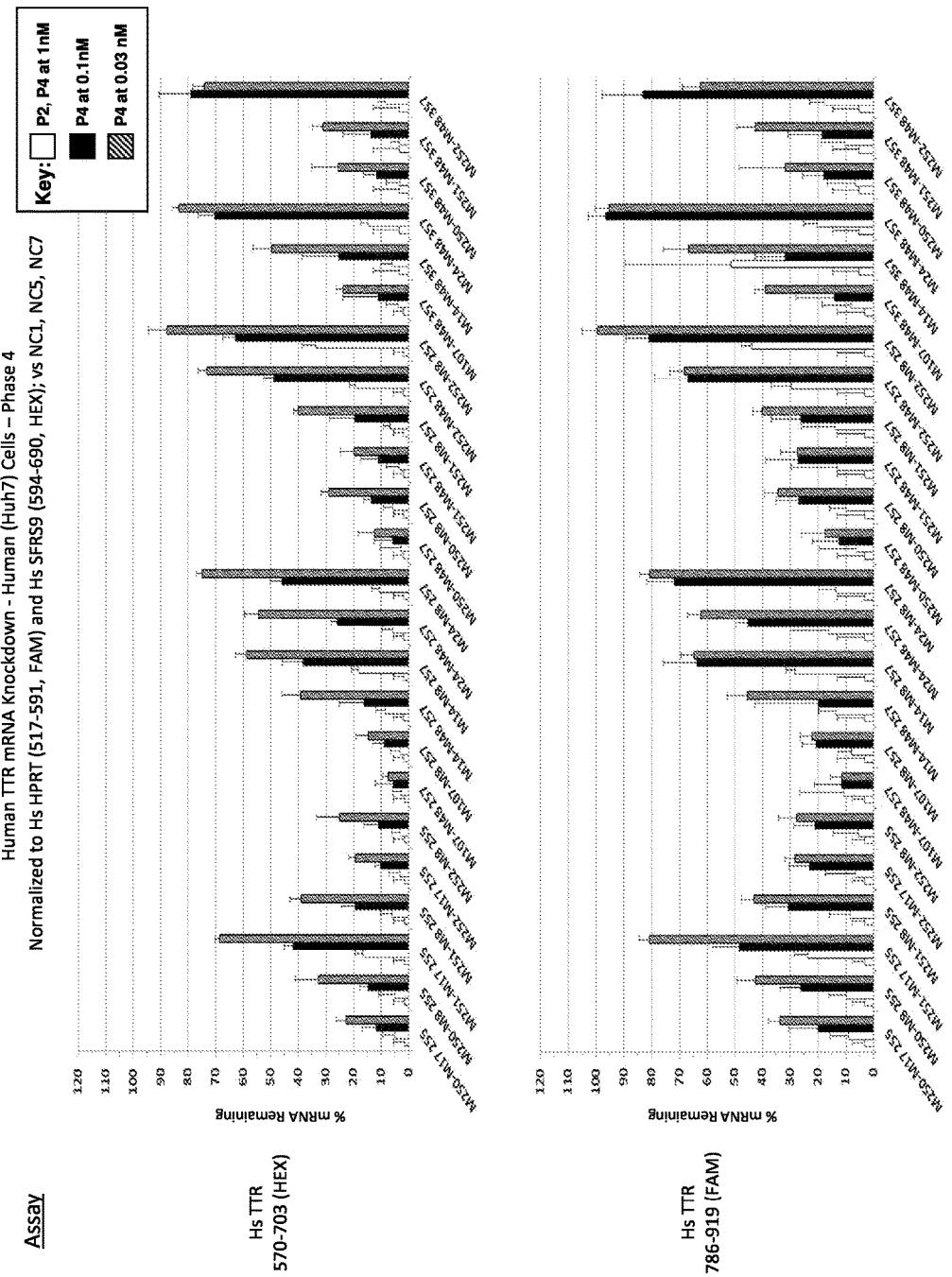

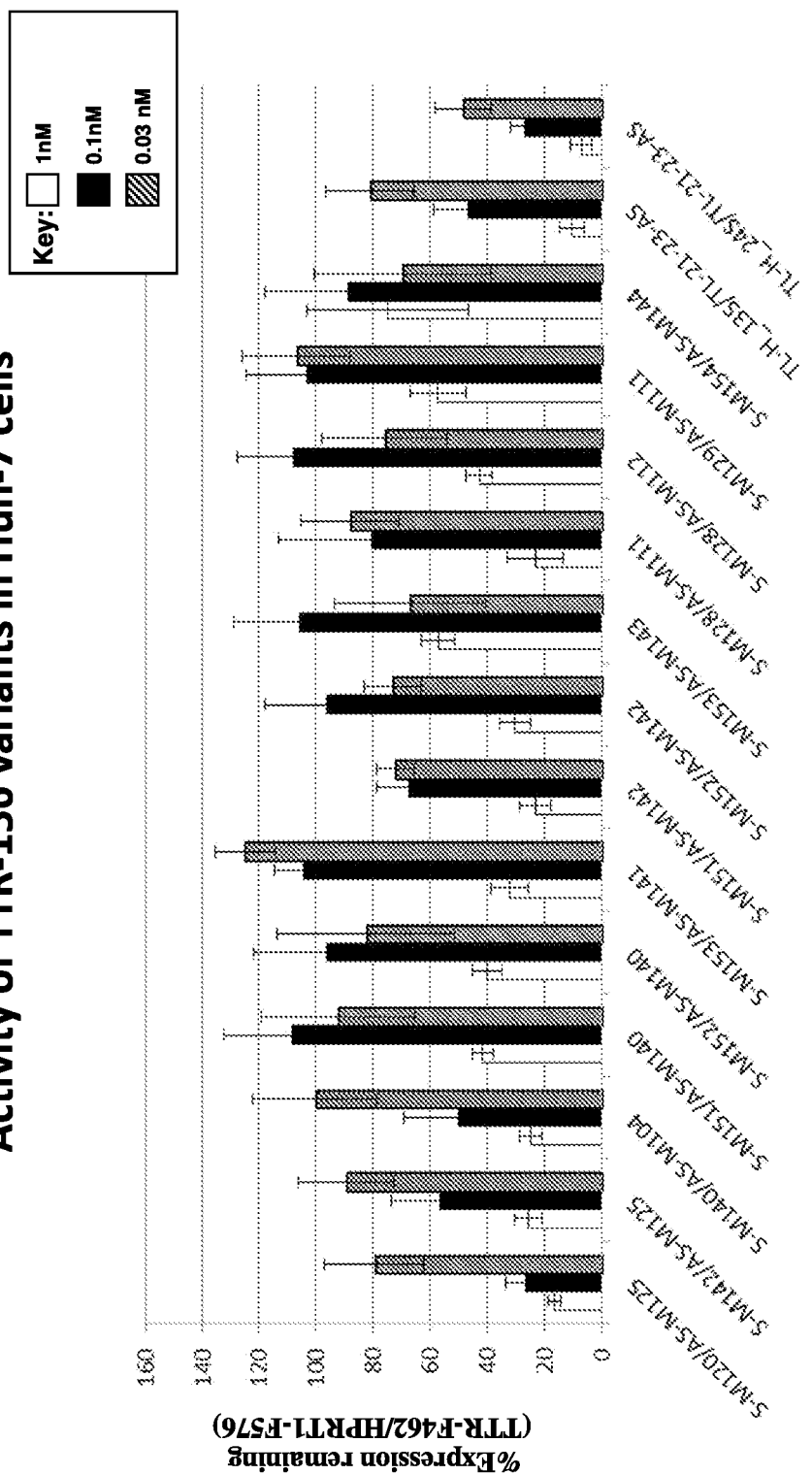

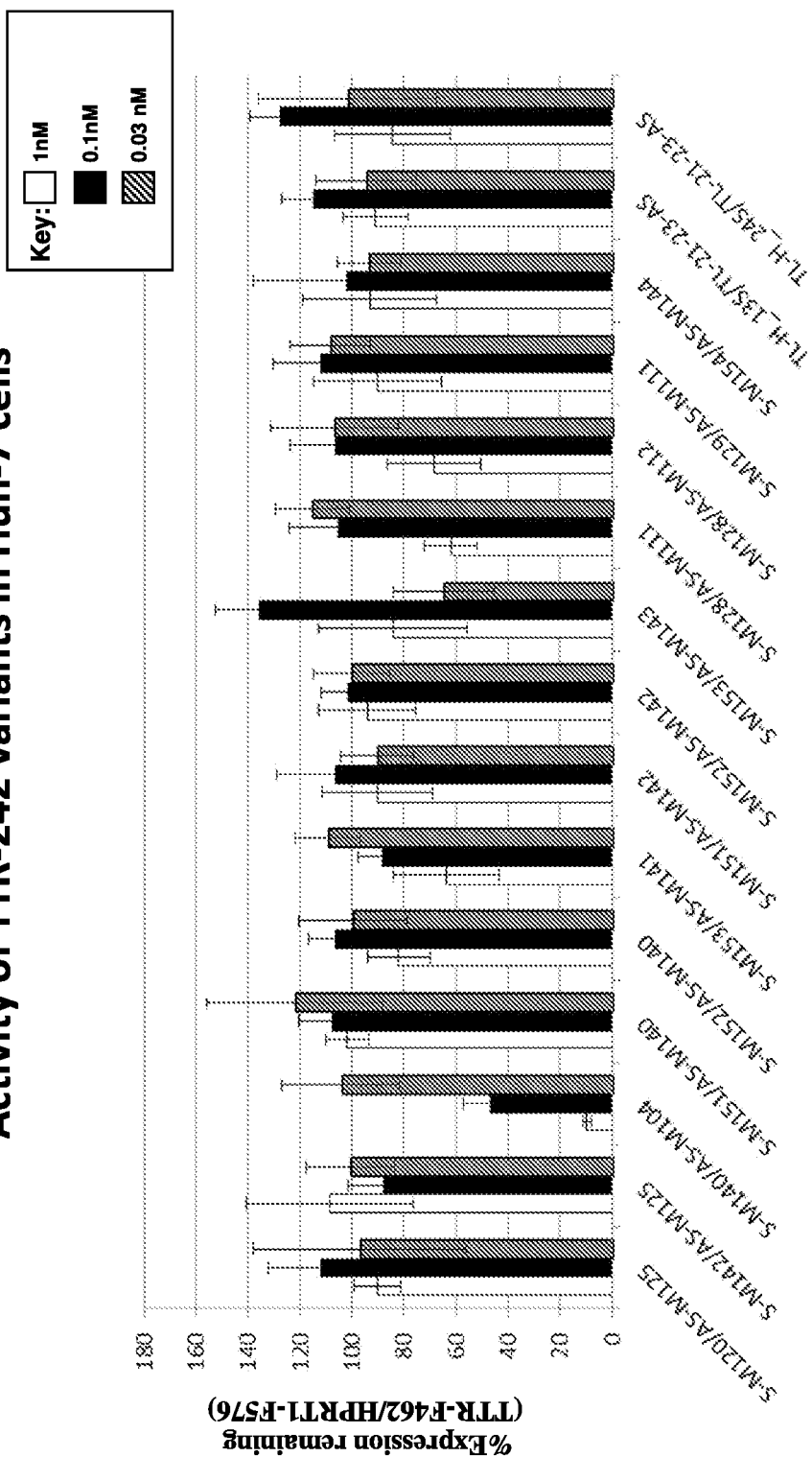

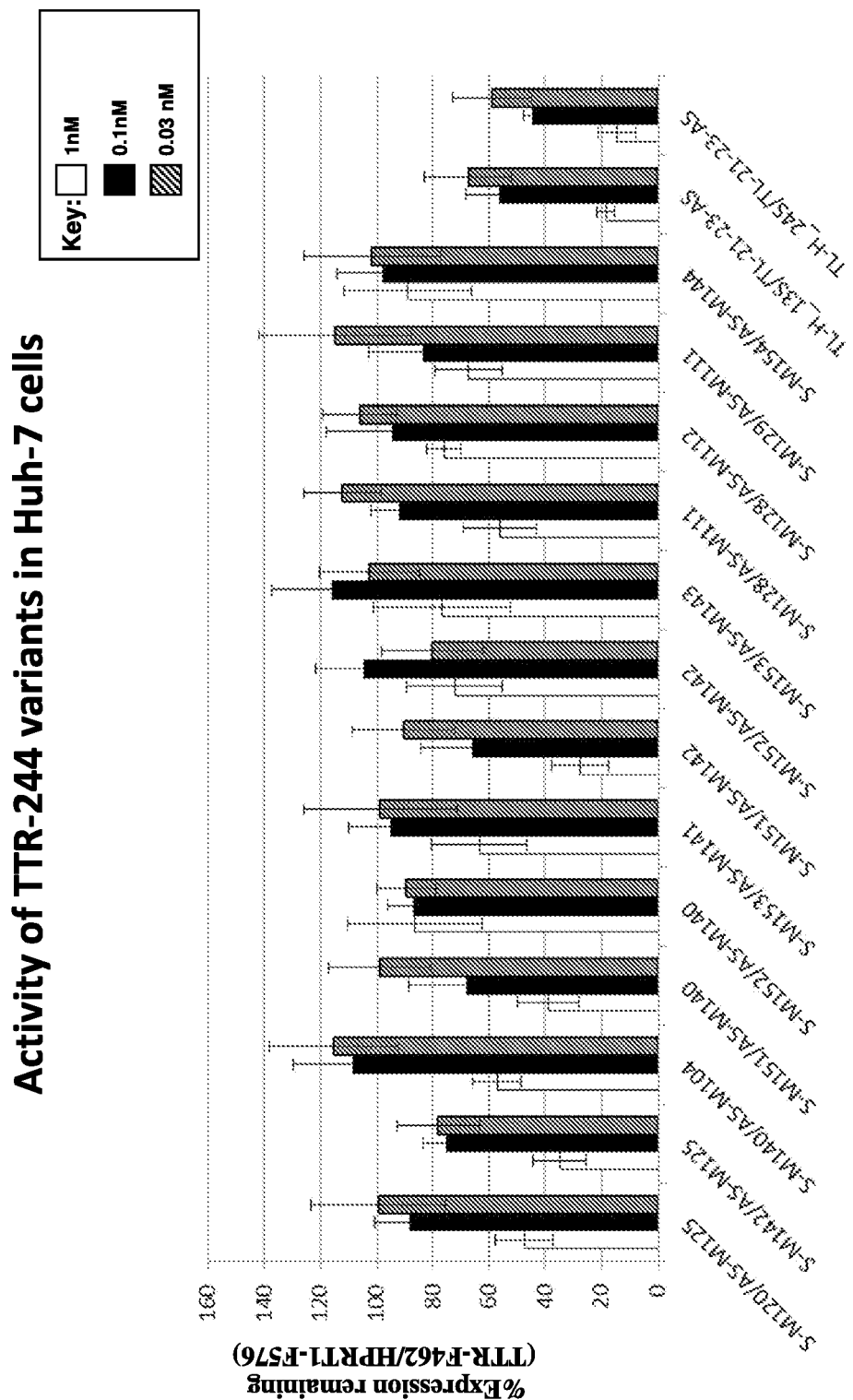

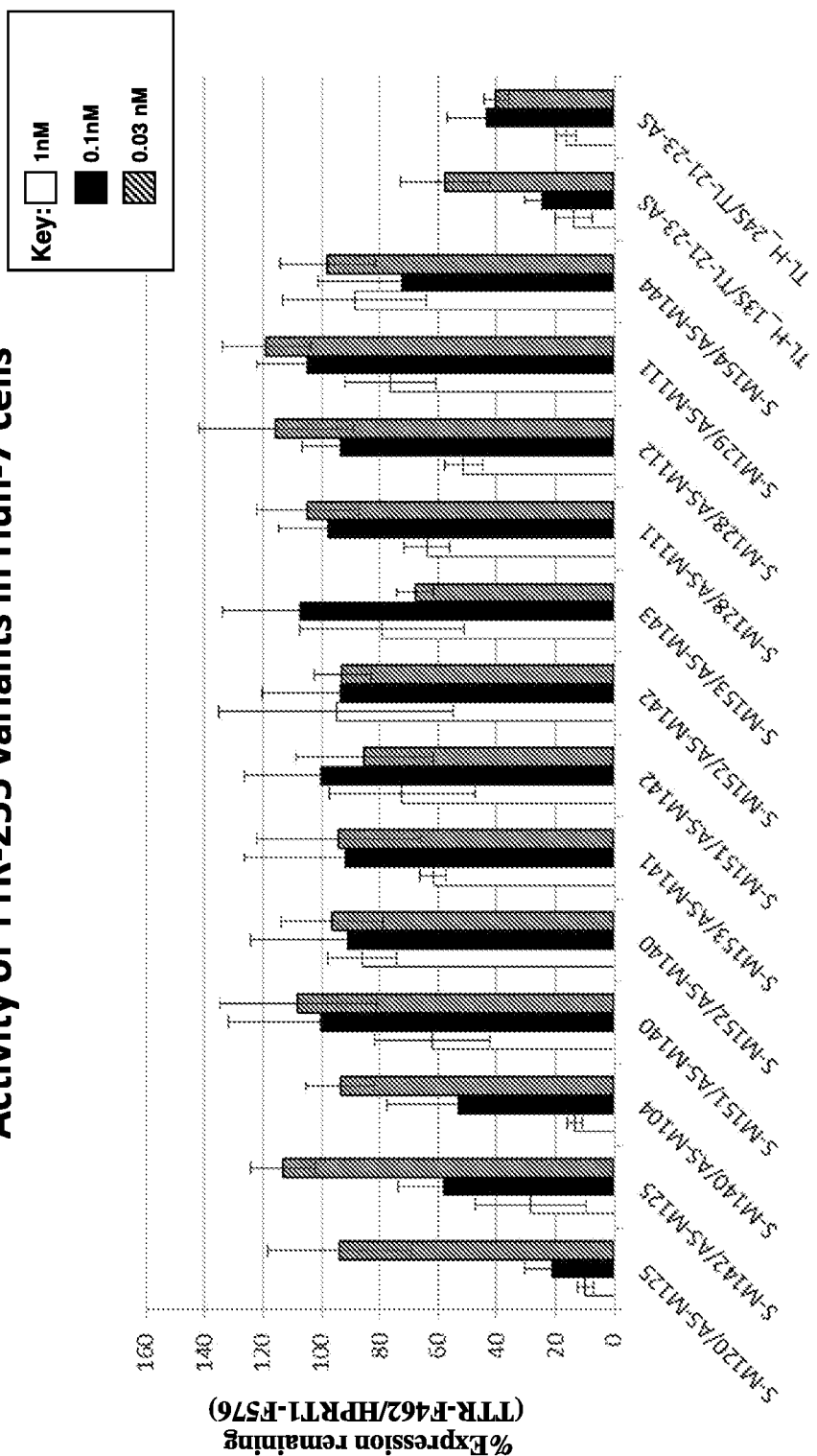

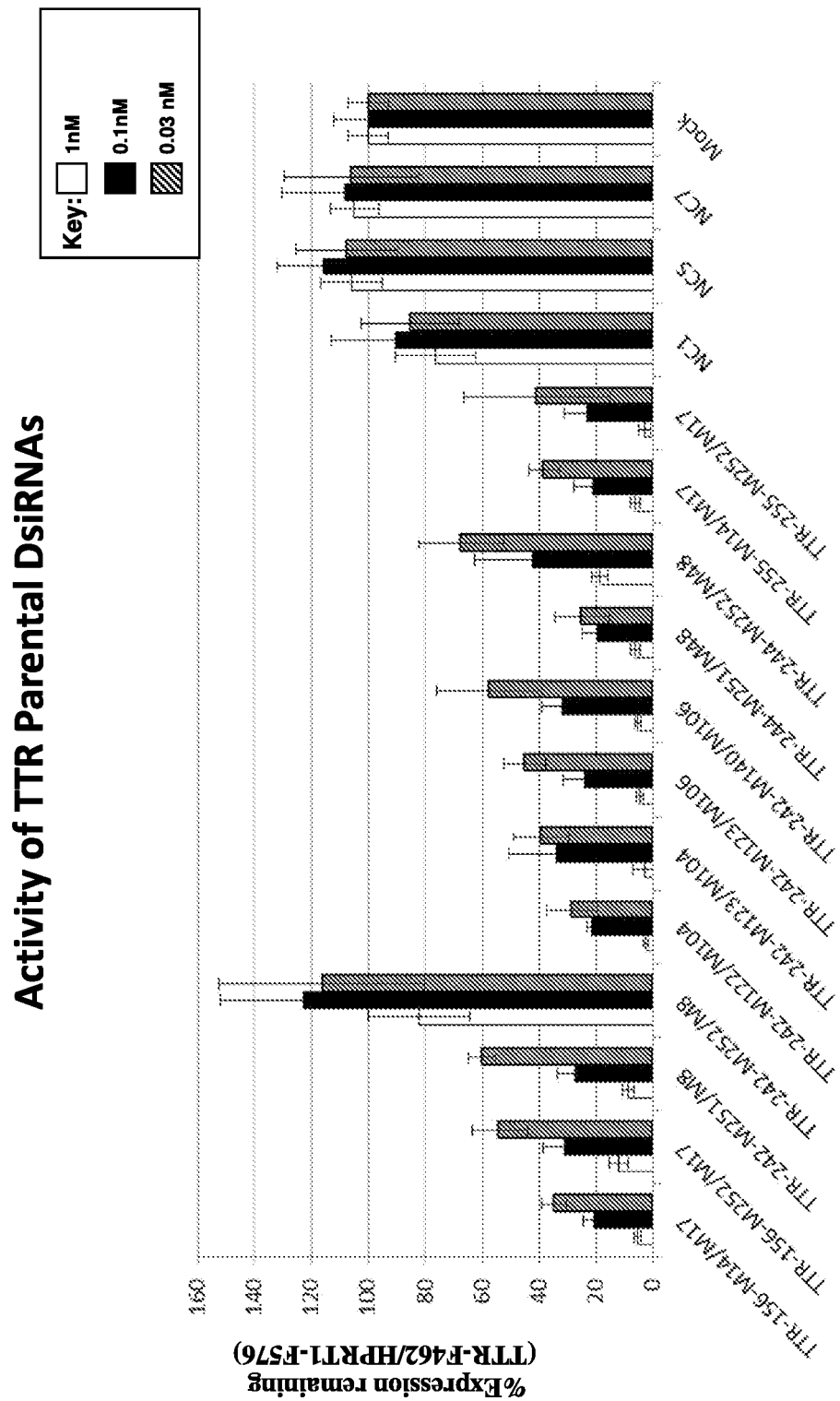

Dose Curves of Nicked Tetraloop DsiRNAs (RNA Tetraloop)

Dose Curves of Nicked Tetraloop DsiRNAs (DNA Tetraloop)

Dose Curves of Modified DsiRNAs

Dose Curves of Modified DsiRNAs

Dose Curves of Modified DsiRNAs

METHODS AND COMPOSITIONS FOR THE SPECIFIC INHIBITION OF TRANSTHYRETIN (TTR) BY DOUBLE-STRANDED RNA

RELATED APPLICATIONS

The present application is the U.S. national phase, pursuant to 35 U.S.C. § 371, of international application Ser. No. PCT/US2014/068764, filed Dec. 5, 2014, designating the United States and published in English on Jun. 11, 2015 as publication No. WO 2015/085158 A1, which claims priority to, and the benefit under 35 U.S.C. § 119(e) of U.S. provisional patent application No. 61/912,891, entitled "Methods and Compositions for the Specific Inhibition of Transthyretin (TTR) by Double-Stranded RNA," filed Dec. 6, 2013. The entire content of the aforementioned patent application is incorporated herein by this reference.

FIELD OF THE INVENTION

The present invention relates to compounds, compositions, and methods for the study, diagnosis, and treatment of traits, diseases and conditions that respond to the modulation of transthyretin gene expression and/or activity.

SEQUENCE SUBMISSION

The present application is being filed along with a Sequence Listing in electronic format. The Sequence Listing is entitled "301937_94008 WO_seq_listing", was created on Dec. 5, 2014 and is 685 kb in size. The information in the electronic format of the Sequence Listing is part of the present application and is incorporated herein by reference in its entirety.

BACKGROUND OF THE INVENTION

Transthyretin (TTR, for "transports thyroxine and retinol" and originally named "prealbumin") is a serum and cerebrospinal fluid carrier of the thyroid hormone thyroxine (T4) and retinol binding protein bound to retinol. The liver secretes transthyretin into the blood, while the choroid plexus secretes TTR into the cerebrospinal fluid. It functions with two other thyroid hormone-binding proteins in the serum, thyroxine-binding globin (TBG) and albumin.

TTR is a 55 kDa homotetramer with a dimer of dimers quaternary structure that is synthesized in the liver, choroid plexus and retinal pigment epithelium for secretion into the bloodstream, cerebrospinal fluid and the eye, respectively. TTR misfolding and aggregation is known to be associated with the amyloid diseases (Zeldenrust and Benson. In Ramirez-Alvarado M, Kelly J W, Dobson C. Protein misfolding diseases: current and emerging principles and therapies. New York: Wiley) senile systemic amyloidosis (SSA; Westermark et al. Proc. Natl. Acad. Sci. U.S.A. 87: 2843-5), familial amyloid polyneuropathy (FAP; Andrade C. Brain 75: 408-27; Coelho T. Curr. Opin. Neurol. 9: 355-9), and familial amyloid cardiomyopathy (FAC; Jacobson et al. N. Engl. J. Med. 336: 466-73).

TTR tetramer dissociation is known to be rate-limiting for amyloid fibril formation (Colon and Kelly. Biochemistry 31: 8654-60; Lai et al. Biochemistry 35: 6470-82; Hammarström et al. Science 299: 713-6). However, the monomer also must partially denature in order for TTR to be misassembly competent, leading to a variety of aggregate structures including amyloid fibrils (Jiang et al. Biochemistry 40: 11442-52). While wild type TTR can dissociate, misfold and aggregate leading to SSA, point mutations within TTR are known to destabilize the tetramer composed of mutant and wild type TTR subunits facilitating more facile dissociation and/or misfolding and amyloidogenesis (Sekijima et al. Cell 121 (1): 73-85). A replacement of valine by methionine at position 30 (TTR V30M) is the mutation most commonly associated with FAP (Saraiva M J. Hum. Mutat. 5: 191-6). A position 122 replacement of valine by isoleucine (TTR V122I) is carried by 3.9% of the African-American population, and is the most common cause of FAC (Jacobson et al. N. Engl. J. Med. 336: 466-73). SSA is estimated to affect over 25% of the population over age 80 (Westermark et al. Proc. Natl. Acad. Sci. U.S.A. 87: 2843-5). Severity of disease varies greatly by mutation, with some mutations causing disease in the first or second decade of life, and others being more benign. Deposition of TTR amyloid is generally observed extracellularly, although TTR deposits are also clearly observed within the cardiomyocytes of the heart.

Both normal-sequence TTR and variant-sequence TTR cause amyloidosis. Normal-sequence TTR causes cardiac amyloidosis in people who are elderly and is termed senile systemic amyloidosis (SSA) (also called senile cardiac amyloidosis (SCA)). SSA often is accompanied by microscopic deposits in many other organs. TTR mutations accelerate the process of TTR amyloid formation and are the most important risk factor for the development of clinically significant TTR amyloidosis (also called ATTR (amyloidosis-transthyretin type)). More than 85 amyloidogenic TTR variants are known to cause systemic familial amyloidosis. The liver is the major site of TTR expression. Other significant sites of expression include the choroid plexus, retina and pancreas. TTR amyloidosis manifests in various forms. When the peripheral nervous system is affected more prominently, the disease is termed familial amyloidotic polyneuropathy (FAP). When the heart is primarily involved but the nervous system is not, the disease is called familial amyloidotic cardiomyopathy (FAC). A third major type of TTR amyloidosis is called leptomeningeal/CNS (Central Nervous System) amyloidosis.

Treatment of familial TTR amyloid disease has historically relied on liver transplantation as a crude form of gene therapy (Holmgren et al. Lancet 341: 1113-6). Inhibitory RNA therapies offer the prospect of a targeted and significantly less invasive alternative to such transplant therapy.

Double-stranded RNA (dsRNA) agents possessing strand lengths of 25 to 35 nucleotides have been described as effective inhibitors of target gene expression in mammalian cells (Rossi et al., U.S. Patent Application Nos. 2005/0244858 and US 2005/0277610). dsRNA agents of such length are believed to be processed by the Dicer enzyme of the RNA interference (RNAi) pathway, leading such agents to be termed "Dicer substrate siRNA" ("DsiRNA") agents. Additional modified structures of DsiRNA agents were previously described (Rossi et al., U.S. Patent Application No. 2007/0265220). Effective extended forms of Dicer substrates have also recently been described (see, e.g., Brown, U.S. Pat. No. 8,349,809 and U.S. Pat. No. 8,513,207).

Provided herein are improved nucleic acid agents that target transthyretin. In particular, those targeting transthyretin have been specifically exemplified.

BRIEF SUMMARY OF THE INVENTION

The present invention is directed to nucleic acid compositions that reduce expression of transthyretin. Such compositions contain nucleic acids such as double stranded RNA ("dsRNA"), and methods for preparing them. The nucleic acids of the invention are capable of reducing the expression of a target transthyretin gene in a cell, either in vitro or in a mammalian subject.

In one aspect, the invention provides a nucleic acid possessing an oligonucleotide strand of 15-53 nucleotides in length, where the oligonucleotide strand is sufficiently complementary to a target transthyretin mRNA sequence of SEQ ID NOs: 1921-2304 along at least 15 nucleotides of the oligonucleotide strand length to reduce transthyretin target mRNA expression when the nucleic acid is introduced into a mammalian cell.

Another aspect of the invention provides a nucleic acid possessing an oligonucleotide strand of 19-53 nucleotides in length, where the oligonucleotide strand is sufficiently complementary to a target transthyretin mRNA sequence of SEQ ID NOs: 1921-2304 along at least 19 nucleotides of the oligonucleotide strand length to reduce transthyretin target mRNA expression when the nucleic acid is introduced into a mammalian cell.

In one embodiment, the oligonucleotide strand is 19-35 nucleotides in length.

An additional aspect of the invention provides a double stranded nucleic acid (dsNA) possessing first and second nucleic acid strands including RNA, where the first strand is 15-66 nucleotides in length and the second strand of the dsNA is 19-66 nucleotides in length, where the second oligonucleotide strand is sufficiently complementary to a target transthyretin mRNA sequence of SEQ ID NOs: 1921-2304 along at least 15 nucleotides of the second oligonucleotide strand length to reduce transthyretin target mRNA expression when the double stranded nucleic acid is introduced into a mammalian cell.

Another aspect of the invention provides a double stranded nucleic acid (dsNA) possessing first and second nucleic acid strands, where the first strand is 15-66 nucleotides in length and the second strand of the dsNA is 19-66 nucleotides in length, where the second oligonucleotide strand is sufficiently complementary to a target transthyretin mRNA sequence of SEQ ID NOs: 1921-2304 along at least 19 nucleotides of the second oligonucleotide strand length to reduce transthyretin target mRNA expression when the double stranded nucleic acid is introduced into a mammalian cell.

A further aspect of the invention provides a double stranded nucleic acid (dsNA) possessing first and second nucleic acid strands, where the first strand is 15-66 nucleotides in length and the second strand of the dsNA is 19-66 nucleotides in length, where the second oligonucleotide strand is sufficiently complementary to a target transthyretin mRNA sequence of SEQ ID NOs: 1921-2304 along at least 19 nucleotides of the second oligonucleotide strand length to reduce transthyretin target mRNA expression, and where, starting from the 5' end of the transthyretin mRNA sequence of SEQ ID NOs: 1921-2304 (position 1), mammalian Ago2 cleaves the mRNA at a site between positions 9 and 10 of the sequence, when the double stranded nucleic acid is introduced into a mammalian cell.

Another aspect of the invention provides a dsNA molecule, consisting of: (a) a sense region and an antisense region, where the sense region and the antisense region together form a duplex region consisting of 25-66 base pairs and the antisense region includes a sequence that is the complement of a sequence of SEQ ID NOs: 1921-2304; and (b) from zero to two 3' overhang regions, where each overhang region is six or fewer nucleotides in length, and where, starting from the 5' end of the transthyretin mRNA sequence of SEQ ID NOs: 1921-2304 (position 1), mammalian Ago2 cleaves the mRNA at a site between positions 9 and 10 of the sequence, when the double stranded nucleic acid is introduced into a mammalian cell.

An additional aspect of the invention provides a double stranded nucleic acid (dsNA) possessing first and second nucleic acid strands and a duplex region of at least 25 base pairs, where the first strand is 25-65 nucleotides in length and the second strand of the dsNA is 26-66 nucleotides in length and includes 1-5 single-stranded nucleotides at its 3' terminus, where the second oligonucleotide strand is sufficiently complementary to a target transthyretin mRNA sequence of SEQ ID NOs: 1921-2304 along at least 19 nucleotides of the second oligonucleotide strand length to reduce transthyretin target gene expression when the double stranded nucleic acid is introduced into a mammalian cell.

Another aspect of the invention provides a double stranded nucleic acid (dsNA) possessing first and second nucleic acid strands and a duplex region of at least 25 base pairs, where the first strand is 25-65 nucleotides in length and the second strand of the dsNA is 26-66 nucleotides in length and includes 1-5 single-stranded nucleotides at its 3' terminus, where the 3' terminus of the first oligonucleotide strand and the 5' terminus of the second oligonucleotide strand form a blunt end, and the second oligonucleotide strand is sufficiently complementary to a target transthyretin sequence of SEQ ID NOs: 1921-2304 along at least 19 nucleotides of the second oligonucleotide strand length to reduce transthyretin mRNA expression when the double stranded nucleic acid is introduced into a mammalian cell.

In one embodiment, the first strand is 15-35 nucleotides in length.

In another embodiment, the second strand is 19-35 nucleotides in length.

In an additional embodiment, the dsNA possesses a duplex region of at least 25 base pairs; 19-21 base pairs or 21-25 base pairs.

Optionally, the second oligonucleotide strand includes 1-5 single-stranded nucleotides at its 3' terminus.

In one embodiment, the second oligonucleotide strand includes 5-35 single-stranded nucleotides at its 3' terminus.

In another embodiment, the single-stranded nucleotides include modified nucleotides. Optionally, the single-stranded nucleotides include 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino and/or 2'-O—(N-methlycarbamate) modified nucleotides.

In certain embodiments, the single-stranded nucleotides include ribonucleotides. Optionally, the single-stranded nucleotides include deoxyribonucleotides.

In certain embodiments, the 3' end of the first strand and the 5' end of the second strand of a dsNA or hybridization complex of the invention are joined by a polynucleotide sequence that includes ribonucleotides, deoxyribonucleotides or both, optionally the polynucleotide sequence includes a tetraloop sequence.

In one embodiment, the first strand is 25-35 nucleotides in length. Optionally, the second strand is 25-35 nucleotides in length.

In one embodiment, the second oligonucleotide strand is complementary to target transthyretin cDNA sequence GenBank Accession No. NM_000371.3 along at most 27 nucleotides of the second oligonucleotide strand length.

In another embodiment, starting from the first nucleotide (position 1) at the 3' terminus of the first oligonucleotide strand, position 1, 2 and/or 3 is substituted with a modified nucleotide.

Optionally, the first strand and the 5' terminus of the second strand form a blunt end.

In one embodiment, the first strand is 25 nucleotides in length and the second strand is 27 nucleotides in length.

In another embodiment, starting from the 5' end of a transthyretin mRNA sequence of SEQ ID NOs: 1921-2304 (position 1), mammalian Ago2 cleaves the mRNA at a site between positions 9 and 10 of the sequence, thereby reducing transthyretin target mRNA expression when the double stranded nucleic acid is introduced into a mammalian cell.

In one embodiment, the second strand includes a sequence of SEQ ID NOs: 385-768. In an additional embodiment, the first strand includes a sequence of SEQ ID NOs: 1-384.

In another embodiment, the dsNA of the invention possesses a pair of first strand/second strand sequences of Table 2.

Optionally, the modified nucleotide residue of the 3' terminus of the first strand is a deoxyribonucleotide, an acyclonucleotide or a fluorescent molecule.

In one embodiment, position 1 of the 3' terminus of the first oligonucleotide strand is a deoxyribonucleotide.

In another embodiment, the nucleotides of the 1-5 or 5-35 single-stranded nucleotides of the 3' terminus of the second strand comprise a modified nucleotide.

In one embodiment, the modified nucleotide of the 1-5 or 5-35 single-stranded nucleotides of the 3' terminus of the second strand is a 2'-O-methyl ribonucleotide.

In an additional embodiment, all nucleotides of the 1-5 or 5-35 single-stranded nucleotides of the 3' terminus of the second strand are modified nucleotides.

In another embodiment, the dsNA includes a modified nucleotide. Optionally, the modified nucleotide residue is 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino or 2'-O—(N-methylcarbamate).

In one embodiment, the 1-5 or 5-35 single-stranded nucleotides of the 3' terminus of the second strand are 1-3 nucleotides in length, optionally 1-2 nucleotides in length.

In another embodiment, the 1-5 or 5-35 single-stranded nucleotides of the 3' terminus of the second strand is two nucleotides in length and includes a 2'-O-methyl modified ribonucleotide.

In one embodiment, the second oligonucleotide strand includes a modification pattern of AS-M1 to AS-M96 and AS-M1* to AS-M96*.

In another embodiment, the first oligonucleotide strand includes a modification pattern of SM1 to SM119.

In an additional embodiment, each of the first and the second strands has a length which is at least 26 and at most 30 nucleotides.

In one embodiment, the dsNA is cleaved endogenously in the cell by Dicer.

In another embodiment, the amount of the nucleic acid sufficient to reduce expression of the target gene is of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of the cell.

In one embodiment, the dsNA possesses greater potency than a 21 mer siRNA directed to the identical at least 19 nucleotides of the target transthyretin mRNA in reducing target transthyretin mRNA expression when assayed in vitro in a mammalian cell at an effective concentration in the environment of a cell of 1 nanomolar or less.

In an additional embodiment, the nucleic acid or dsNA is sufficiently complementary to the target transthyretin mRNA sequence to reduce transthyretin target mRNA expression by an amount (expressed by %) of at least 10%, at least 50%, at least 80-90%, at least 95%, at least 98%, or at least 99% when the double stranded nucleic acid is introduced into a mammalian cell.

In one embodiment, the first and second strands are joined by a chemical linker.

In another embodiment, the 3' terminus of the first strand and the 5' terminus of the second strand are joined by a chemical linker.

In an additional embodiment, a nucleotide of the second or first strand is substituted with a modified nucleotide that directs the orientation of Dicer cleavage.

In one embodiment, the nucleic acid, dsNA or hybridization complex possesses a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, or a locked nucleic acid modified nucleotide.

In another embodiment, the nucleic acid, dsNA or hybridization complex includes a phosphonate, a phosphorothioate or a phosphotriester phosphate backbone modification.

In one embodiment, the nucleic acid, dsNA or hybridization complex includes a morpholino nucleic acid or a peptide nucleic acid (PNA).

In an additional embodiment, the nucleic acid, dsNA or hybridization complex is attached to a dynamic polyconjugate (DPC).

In one embodiment, the nucleic acid, dsNA or hybridization complex is administered with a DPC, where the dsNA and DPC are optionally not attached.

In another embodiment, the nucleic acid, dsNA or hybridization complex is attached to a GalNAc moiety, a cholesterol and/or a cholesterol targeting ligand.

Another aspect of the invention provides a composition of the following:

a dsNA possessing first and second nucleic acid strands, where the first strand is 15-35 nucleotides in length and the second strand of the dsNA is 19-35 nucleotides in length, where the second oligonucleotide strand is sufficiently complementary to a target transthyretin mRNA sequence of SEQ ID NOs: 1921-2304 along at least 19 nucleotides of the second oligonucleotide strand length to reduce transthyretin target mRNA expression when the double stranded nucleic acid is introduced into a mammalian cell;

a dsNA possessing first and second nucleic acid strands, where the first strand is 15-35 nucleotides in length and the second strand of the dsNA is 19-35 nucleotides in length, where the second oligonucleotide strand is sufficiently complementary to a target transthyretin mRNA sequence of SEQ ID NOs: 1921-2304 along at least 19 nucleotides of the second oligonucleotide strand length to reduce transthyretin target mRNA expression, and where, starting from the 5' end of the transthyretin mRNA sequence of SEQ ID NOs: 1921-2304 (position 1), mammalian Ago2 cleaves the mRNA at a site between positions 9 and 10 of the sequence, when the double stranded nucleic acid is introduced into a mammalian cell;

a dsNA molecule, consisting of: (a) a sense region and an antisense region, where the sense region and the antisense region together form a duplex region consisting of 25-35 base pairs and the antisense region includes a sequence that is the complement of a sequence of SEQ ID NOs: 1921-2304; and (b) from zero to two 3' overhang regions, where each overhang region is six or fewer nucleotides in length, and where, starting from the 5' end of the transthyretin mRNA sequence of SEQ ID NOs: 1921-2304 (position 1), mammalian Ago2 cleaves the mRNA at a site between positions 9 and 10 of the sequence, when the double stranded nucleic acid is introduced into a mammalian cell;

a dsNA possessing first and second nucleic acid strands and a duplex region of at least 25 base pairs, where the first strand is 25-34 nucleotides in length and the second strand of the dsNA is 26-35 nucleotides in length and includes 1-5 single-stranded nucleotides at its 3' terminus, where the second oligonucleotide strand is sufficiently complementary to a target transthyretin mRNA sequence of SEQ ID NOs: 1921-2304 along at least 19 nucleotides of the second oligonucleotide strand length to reduce transthyretin target gene expression when the double stranded nucleic acid is introduced into a mammalian cell;

a dsNA possessing first and second nucleic acid strands and a duplex region of at least 25 base pairs, where the first strand is 25-34 nucleotides in length and the second strand of the dsNA is 26-35 nucleotides in length and includes 1-5 single-stranded nucleotides at its 3' terminus, where the 3' terminus of the first oligonucleotide strand and the 5' terminus of the second oligonucleotide strand form a blunt end, and the second oligonucleotide strand is sufficiently complementary to a target transthyretin sequence of SEQ ID NOs: 1921-2304 along at least 19 nucleotides of the second oligonucleotide strand length to reduce transthyretin mRNA expression when the double stranded nucleic acid is introduced into a mammalian cell;

a nucleic acid possessing an oligonucleotide strand of 19-35 nucleotides in length, where the oligonucleotide strand is sufficiently complementary to a target transthyretin mRNA sequence of SEQ ID NOs: 1921-2304 along at least 19 nucleotides of the oligonucleotide strand length to reduce transthyretin target mRNA expression when the nucleic acid is introduced into a mammalian cell;

a nucleic acid possessing an oligonucleotide strand of 15-35 nucleotides in length, where the oligonucleotide strand is hybridizable to a target transthyretin mRNA sequence of SEQ ID NOs: 1921-2304 along at least 15 nucleotides of the oligonucleotide strand length;

a dsNA possessing first and second nucleic acid strands possessing RNA, where the first strand is 15-35 nucleotides in length and the second strand of the dsNA is 19-35 nucleotides in length, where the second oligonucleotide strand is hybridizable to a target transthyretin mRNA sequence of SEQ ID NOs: 1921-2304 along at least 15 nucleotides of the second oligonucleotide strand length;

a dsNA possessing first and second nucleic acid strands possessing RNA, where the first strand is 15-35 nucleotides in length and the second strand of the dsNA is at least 35 nucleotides in length and optionally includes a sequence of at least 25 nucleotides in length of SEQ ID NOs: 385-768, where the second oligonucleotide strand is sufficiently complementary to a target transthyretin mRNA sequence of SEQ ID NOs: 1921-2304 along at least 15 nucleotides of the second oligonucleotide strand length to reduce transthyretin target mRNA expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where the first strand is 25 to 53 nucleotide residues in length, where starting from the first nucleotide (position 1) at the 5' terminus of the first strand, positions 1 to 23 of the first strand are ribonucleotides or modified ribonucleotides; the second strand is 27 to 53 nucleotide residues in length and includes 23 consecutive ribonucleotides or modified ribonucleotides that base pair with the ribonucleotides or ribonucleotides of positions 1 to 23 of the first strand to form a duplex; the 5' terminus of the first strand and the 3' terminus of the second strand form a structure of a blunt end, a 1-6 nucleotide 5' overhang and a 1-6 nucleotide 3' overhang; the 3' terminus of the first strand and the 5' terminus of the second strand form a structure of a blunt end, a 1-6 nucleotide 5' overhang and a 1-6 nucleotide 3' overhang; at least one of positions 24 to the 3' terminal nucleotide residue of the first strand is a deoxyribonucleotide or modified ribonucleotide that optionally base pairs with a deoxyribonucleotide of the second strand; and the second strand is sufficiently complementary to a target transthyretin mRNA sequence of SEQ ID NOs: 1921-2304 along at least 15 nucleotides of the second oligonucleotide strand length to reduce transthyretin target mRNA expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where the second strand is 27 to 53 nucleotide residues in length, where starting from the first nucleotide (position 1) at the 5' terminus of the second strand, positions 1 to 23 of the second strand are ribonucleotides or modified ribonucleotides; the first strand is 25 to 53 nucleotide residues in length and includes 23 consecutive ribonucleotides or modified ribonucleotides that base pair sufficiently with the ribonucleotides of positions 1 to 23 of the second strand to form a duplex; at least one of positions 24 to the 3' terminal nucleotide residue of the second strand is a deoxyribonucleotide or modified ribonucleotide, optionally that base pairs with a deoxyribonucleotide or modified ribonucleotide of the first strand; and the second strand is sufficiently complementary to a target transthyretin mRNA sequence of SEQ ID NOs: 1921-2304 along at least 15 nucleotides of the second oligonucleotide strand length to reduce transthyretin target mRNA expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first strand (or the second strand) is 25-30 nucleotide residues in length, where starting from the 5' terminal nucleotide (position 1) positions 1 to 23 of the first strand (or the second strand) include at least 8 ribonucleotides; the second strand (or the first strand) is 36-66 nucleotide residues in length and, starting from the 3' terminal nucleotide, includes at least 8 ribonucleotides in the positions paired with positions 1-23 of the first strand to form a duplex; where at least the 3' terminal nucleotide of the second strand (or the first strand) is unpaired with the first strand (or the second strand), and up to 6 consecutive 3' terminal nucleotides are unpaired with the first strand (or the second strand), thereby forming a 3' single stranded overhang of 1-6 nucleotides; where the 5' terminus of the second strand (or the first strand) includes from 10-30 consecutive nucleotides which are unpaired with the first strand (or the second strand), thereby forming a 10-30 nucleotide single stranded 5' overhang; where at least the first strand (or the second strand) 5' terminal and 3' terminal nucleotides are base paired with nucleotides of the second strand (or first strand) when the first and second strands are aligned for maximum complementarity, thereby forming a substantially duplexed region between the first and second strands; and the second strand is sufficiently complementary to a target RNA along at least 19 ribonucleotides of the second strand length to reduce target gene expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first strand is 25-35 nucleotide residues in length, where starting from the 5' terminal nucleotide (position 1) positions 1 to 25 of the second strand include at least 8 ribonucleotides; the second strand is 30-66 nucleotide residues in length and, starting from the 3' terminal nucleotide, includes at least 8 ribonucleotides in the positions paired with positions 1-25 of the first strand to form a duplex; where the 5' terminus of the second strand includes from 5-35 consecutive nucleotides which are unpaired with the first strand, thereby forming a 5-35 nucleotide single stranded 5' overhang; where at least the first strand 5' terminal and 3' terminal nucleotides are base paired with nucleotides of the second strand when the first and second strands are aligned for maximum complementarity, thereby forming a substantially duplexed region between the first and second strands; and the second strand is sufficiently complementary to a target transthyretin mRNA sequence of SEQ ID NOs: 1921-2304 along at least 15 nucleotides of the second oligonucleotide strand length to reduce transthyretin target mRNA expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the second strand is 19-30 nucleotide residues in length and optionally 25-30 nucleotide residues in length, where starting from the 5' terminal nucleotide (position 1) positions 1 to 17 (optionally positions 1 to 23) of the second strand include at least 8 ribonucleotides; the first strand is 24-66 nucleotide residues in length (optionally 30-66 nucleotide residues in length) and, starting from the 3' terminal nucleotide, includes at least 8 ribonucleotides in the positions paired with positions 1 to 17 (optionally positions 1 to 23) of the second strand to form a duplex; where the 3' terminus of the first strand and the 5' terminus of the second strand comprise a structure of a blunt end, a 3' overhang and a 5' overhang, optionally where the overhang is 1-6 nucleotides in length; where the 5' terminus of the first strand includes from 5-35 consecutive nucleotides which are unpaired with the second strand, thereby forming a 5-35 nucleotide single-stranded 5' overhang; where at least the second strand 5' terminal and 3' terminal nucleotides are base paired with nucleotides of the first strand when the first and second strands are aligned for maximum complementarity, thereby forming a substantially duplexed region between the first and second strands; and the second strand is sufficiently complementary to a target transthyretin mRNA sequence of SEQ ID NOs: 1921-2304 along at least 15 nucleotides of the second oligonucleotide strand length to reduce transthyretin target mRNA expression when the double stranded nucleic acid is introduced into a mammalian cell;

a dsNA possessing a first strand and a second strand, where the first strand and the second strand form a duplex region of 19-25 nucleotides in length, where the first strand includes a 3' region that extends beyond the first strand-second strand duplex region and includes a tetraloop, and the dsNA further includes a discontinuity between the 3' terminus of the first strand and the 5' terminus of the second strand, and the first or second strand is sufficiently complementary to a target transthyretin mRNA sequence of SEQ ID NOs: 1921-2304 along at least 15 nucleotides of the first or second strand length to reduce transthyretin target mRNA expression when the dsNA is introduced into a mammalian cell;

a dsNA possessing a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first oligonucleotide strand is 25-53 nucleotides in length and the second is oligonucleotide strand is 25-53 nucleotides in length, and where the dsNA is sufficiently highly modified to substantially prevent dicer cleavage of the dsNA, optionally where the dsNA is cleaved by non-dicer nucleases to yield one or more 19-23 nucleotide strand length dsNAs capable of reducing LDH mRNA expression in a mammalian cell;

an in vivo hybridization complex within a cell of an exogenous nucleic acid sequence and a target Transthyretin mRNA sequence of SEQ ID NOs: 1921-2304; and an in vitro hybridization complex within a cell of an exogenous nucleic acid sequence and a target Transthyretin mRNA sequence of SEQ ID NOs: 1921-2304.

In one embodiment, a dsNA of the invention possesses a duplex region of at least 25 base pairs, where the dsNA possesses greater potency than a 21 mer siRNA directed to the identical at least 19 nucleotides of the target transthyretin mRNA in reducing target transthyretin mRNA expression when assayed in vitro in a mammalian cell at an effective concentration in the environment of a cell of 1 nanomolar or less.

In another embodiment, the dsNA of the invention has a duplex region of at least 25 base pairs, where the dsNA possesses greater potency than a 21 mer siRNA directed to the identical at least 19 nucleotides of the target transthyretin mRNA in reducing target transthyretin mRNA expression when assayed in vitro in a mammalian cell at a concentration of 1 nanomolar, 200 picomolar, 100 picomolar, 50 picomolar, 20 picomolar, 10 picomolar, 5 picomolar, 2, picomolar and 1 picomolar.

In an additional embodiment, the dsNA of the invention possesses four or fewer mismatched nucleic acid residues with respect to the target transthyretin mRNA sequence along 15 or 19 consecutive nucleotides of the at least 15 or 19 nucleotides of the second oligonucleotide strand when the 15 or 19 consecutive nucleotides of the second oligonucleotide are aligned for maximum complementarity with the target transthyretin mRNA sequence.

In another embodiment, the dsNA of the invention possesses three or fewer mismatched nucleic acid residues with respect to the target transthyretin mRNA sequence along 15 or 19 consecutive nucleotides of the at least 15 or 19 nucleotides of the second oligonucleotide strand when the 15 or 19 consecutive nucleotides of the second oligonucleotide are aligned for maximum complementarity with the target transthyretin mRNA sequence.

Optionally, the dsNA of the invention possesses two or fewer mismatched nucleic acid residues with respect to the target transthyretin mRNA sequence along 15 or 19 consecutive nucleotides of the at least 15 or 19 nucleotides of the second oligonucleotide strand when the 15 or 19 consecutive nucleotides of the second oligonucleotide are aligned for maximum complementarity with the target transthyretin mRNA sequence.

In certain embodiments, the dsNA of the invention possesses one mismatched nucleic acid residue with respect to the target transthyretin mRNA sequence along 15 or 19 consecutive nucleotides of the at least 15 or 19 nucleotides of the second oligonucleotide strand when the 15 or 19 consecutive nucleotides of the second oligonucleotide are aligned for maximum complementarity with the target transthyretin mRNA sequence.

In one embodiment, 15 or 19 consecutive nucleotides of the at least 15 or 19 nucleotides of the second oligonucleotide strand are completely complementary to the target transthyretin mRNA sequence when the 15 or 19 consecutive nucleotides of the second oligonucleotide are aligned for maximum complementarity with the target transthyretin mRNA sequence.

Another aspect of the invention provides a method for reducing expression of a target transthyretin gene in a mammalian cell involving contacting a mammalian cell in vitro with a nucleic acid, dsNA or hybridization complex of the invention in an amount sufficient to reduce expression of a target transthyretin mRNA in the cell.

Optionally, target transthyretin mRNA expression is reduced by an amount (expressed by %) of at least 10%, at least 50% and at least 80-90%.

In one embodiment, transthyretin mRNA levels are reduced by an amount (expressed by %) of at least 90% at least 8 days after the cell is contacted with the dsNA.

In another embodiment, transthyretin mRNA levels are reduced by an amount (expressed by %) of at least 70% at least 10 days after the cell is contacted with the dsNA.

A further aspect of the invention provides a method for reducing expression of a target transthyretin mRNA in a mammal possessing administering a nucleic acid, dsNA or hybridization complex of the invention to a mammal in an amount sufficient to reduce expression of a target transthyretin mRNA in the mammal.

In one embodiment, the nucleic acid, dsNA or hybridization complex is formulated in a lipid nanoparticle (LNP).

In another embodiment, the nucleic acid, dsNA or hybridization complex is administered at a dosage of 1 microgram to 5 milligrams per kilogram of the mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

In certain embodiments, the nucleic acid, dsNA or hybridization complex possesses greater potency than 21 mer siRNAs directed to the identical at least 19 nucleotides of the target transthyretin mRNA in reducing target transthyretin mRNA expression when assayed in vitro in a mammalian cell at an effective concentration in the environment of a cell of 1 nanomolar or less.

In one embodiment, transthyretin mRNA levels are reduced in a tissue of the mammal by an amount (expressed by %) of at least 70% at least 3 days after the dsNA is administered to the mammal.

Optionally, the tissue is liver tissue.

In certain embodiments, the administering step involves intravenous injection, intramuscular injection, intraperitoneal injection, infusion, subcutaneous injection, transdermal, aerosol, rectal, vaginal, topical, oral or inhaled delivery.

Another aspect of the invention provides a method for treating or preventing a disease or disorder in a subject that involves administering to the subject an amount of a nucleic acid, dsNA or hybridization complex of the invention in an amount sufficient to treat or prevent the disease or disorder in the subject.

In one embodiment, the disease or disorder is amyloidosis.

Optionally, the subject is human.

A further aspect of the invention provides a formulation that includes the nucleic acid, dsNA or hybridization complex of the invention, where the nucleic acid, dsNA or hybridization complex is present in an amount effective to reduce target transthyretin mRNA levels when the nucleic acid, dsNA or hybridization complex is introduced into a mammalian cell in vitro by an amount (expressed by %) of at least 10%, at least 50% and at least 80-90%.

In one embodiment, the effective amount is of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of the cell.

In another embodiment, the nucleic acid, dsNA or hybridization complex is present in an amount effective to reduce target transthyretin mRNA levels when the nucleic acid, dsNA or hybridization complex is introduced into a cell of a mammalian subject by an amount (expressed by %) of at least 10%, at least 50% and at least 80-90%.

Optionally, the effective amount is a dosage of 1 microgram to 5 milligrams per kilogram of the subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In another embodiment, the nucleic acid, dsNA or hybridization complex possesses greater potency than an 21 mer siRNA directed to the identical at least 19 nucleotides of the target transthyretin mRNA in reducing target transthyretin mRNA levels when assayed in vitro in a mammalian cell at an effective concentration in the environment of a cell of 1 nanomolar or less.

A further aspect of the invention provides a mammalian cell containing the nucleic acid, dsNA or hybridization complex of the invention.

Another aspect of the invention provides a pharmaceutical composition that includes the nucleic acid, dsNA or hybridization complex of the invention and a pharmaceutically acceptable carrier.

An additional aspect of the invention provides a kit including the nucleic acid, dsNA or hybridization complex of the invention and instructions for its use.

A further aspect of the invention provides a composition possessing transthyretin inhibitory activity consisting essentially of a nucleic acid, dsNA or hybridization complex of the invention.

BRIEF DESCRIPTION OF THE DRAWINGS

FIGS. 2A to 2D present primary screen data showing DsiRNA-mediated knockdown of human transthyretin (FIGS. 2A and 2B) and mouse transthyretin (FIGS. 2C and 2D) in human (Huh7) and mouse (AML12) cells, respectively. For each DsiRNA tested, two independent qPCR amplicons were assayed (in human cells, amplicons "67-196" and "570-703" were assayed, while in mouse cells, amplicons "340-469" and "961-1073" were assayed).

FIGS. 3A to 3H show histograms of human and mouse transthyretin inhibitory efficacies observed for indicated DsiRNAs. "P1" indicates phase 1 (primary screen), while "P2" indicates phase 2. In phase 1, DsiRNAs were tested at 1 nM in the environment of Huh7 cells (human cell assays; FIGS. 3A to 3D) or mouse cells (AML12 cell assays; FIGS. 3E to 3H). In phase 2, DsiRNAs were tested at 1 nM, 0.1 nM and 0.03 nM in the environment of Huh7 cells. Individual bars represent average human (FIGS. 3A to 3D) or mouse (FIGS. 3E to 3H) transthyretin levels observed in triplicate, with standard errors shown. Human transthyretin levels were normalized to HPRT and SFRS9 levels, while mouse transthyretin levels were normalized to HPRT and Rpl23 levels.

FIGS. 4A to 4D present histograms showing efficacy data for 24 independent TTR-targeting DsiRNA sequences across four different guide (antisense) strand 2'-O-methyl modification patterns ("M17", "M35", "M48" and "M8", respectively, as shown in FIGS. 4A to 4D, noting that modification patterns are recited as passenger strand modification pattern (here, "M107")-guide strand modification pattern, e.g., "M107-M17", "M107-M35", "M107-M48" or "M107-M8") in human Huh7 cells at 1 nM (both Phase 1 and Phase 3 results are shown), 0.1 nM and 0.03 nM.

FIGS. 5A to 5D present histograms showing efficacy data for nine independent TTR-targeting DsiRNA sequences across varying passenger (sense) and guide (antisense) strand 2'-O-methyl modification patterns (modification patterns are recited as passenger strand modification pattern-guide strand modification pattern) in human Huh7 cells at 1 nM (both Phase 2 and Phase 4 results are shown), 0.1 nM and 0.03 nM.

In FIG. 6D, tetraloop-containing duplex sequences correspond to SEQ ID NO: 3479.

FIGS. 7A to 7E show in vitro TTR inhibitory activity results for further modified forms of TTR-156, TTR-242, TTR-244 and TTR-255 dsRNAs.

In FIGS. 8A and 8B, tetraloop-containing duplex sequences again correspond to SEQ ID NO: 3479.

DETAILED DESCRIPTION OF THE INVENTION

Figure 1:
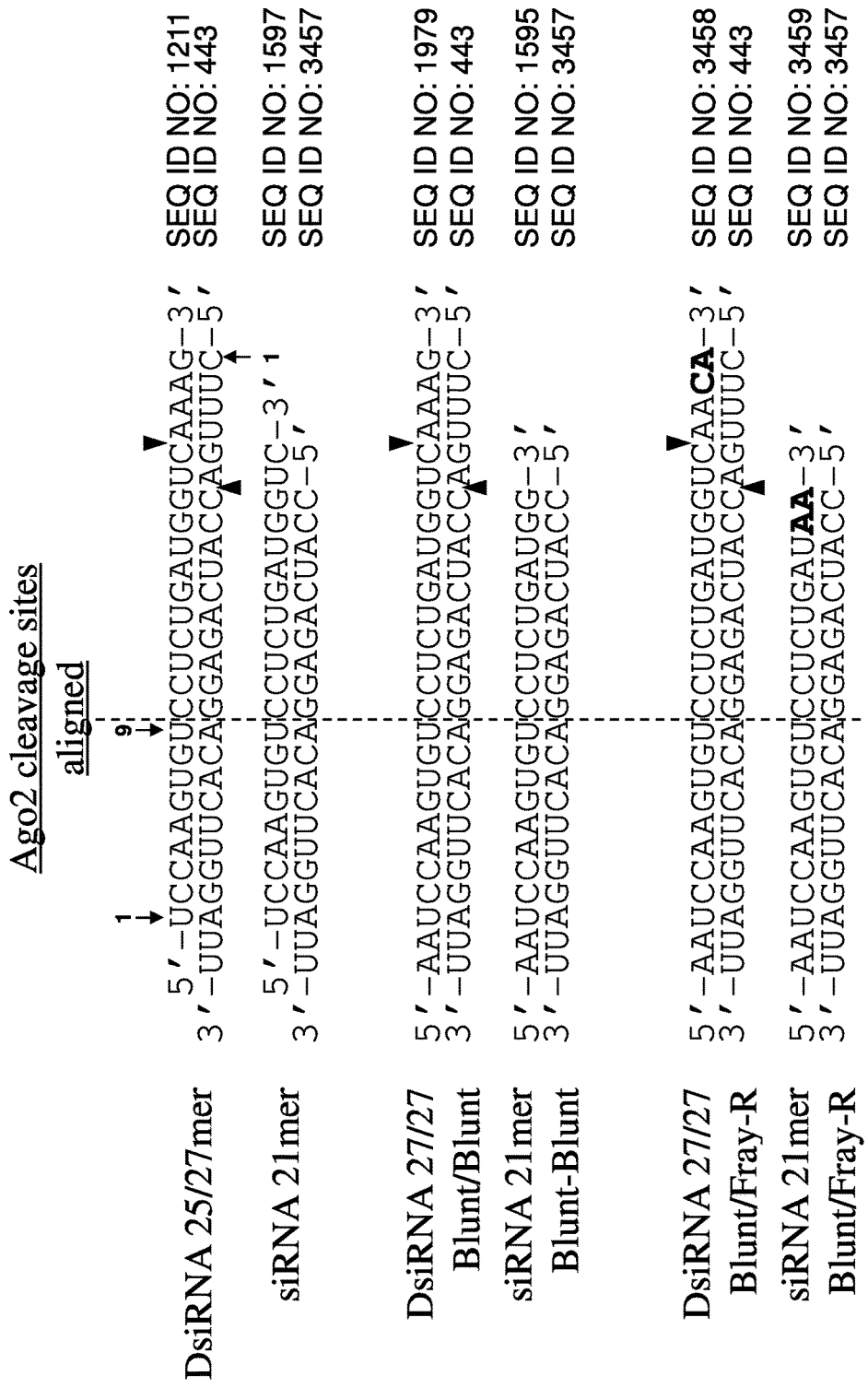
FIG. 1 shows the structures of exemplary DsiRNA agents of the invention targeting a site in the transthyretin RNA referred to herein as the "Transthyretin-242" target site. UPPER case=unmodified RNA, lower case=DNA, Bold=mismatch base pair nucleotides; arrowheads indicate projected Dicer enzyme cleavage sites; dashed line indicates sense strand (top strand) sequences corresponding to the projected Argonaute 2 (Ago2) cleavage site within the targeted transthyretin sequence.
Figure 2B:
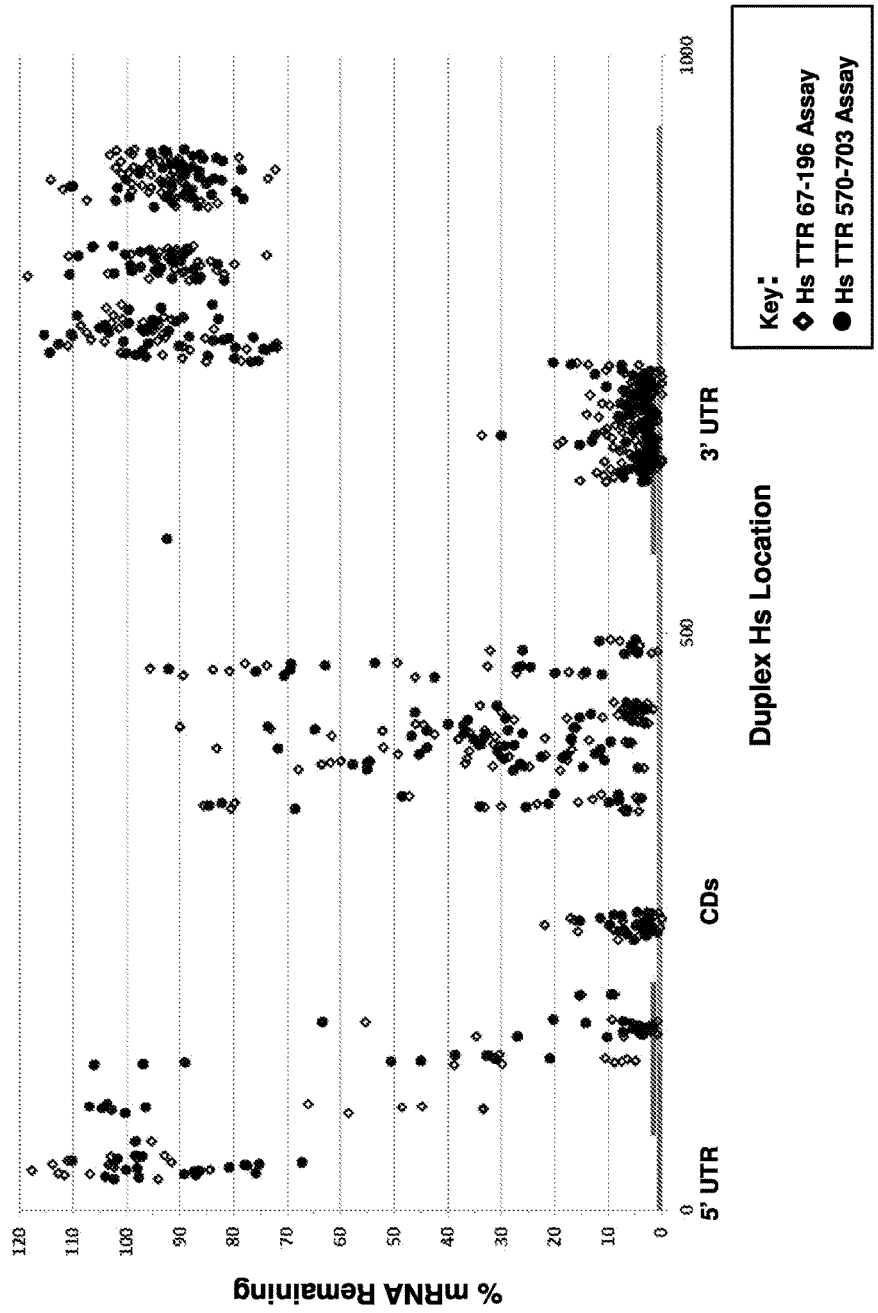
Figure 2D:
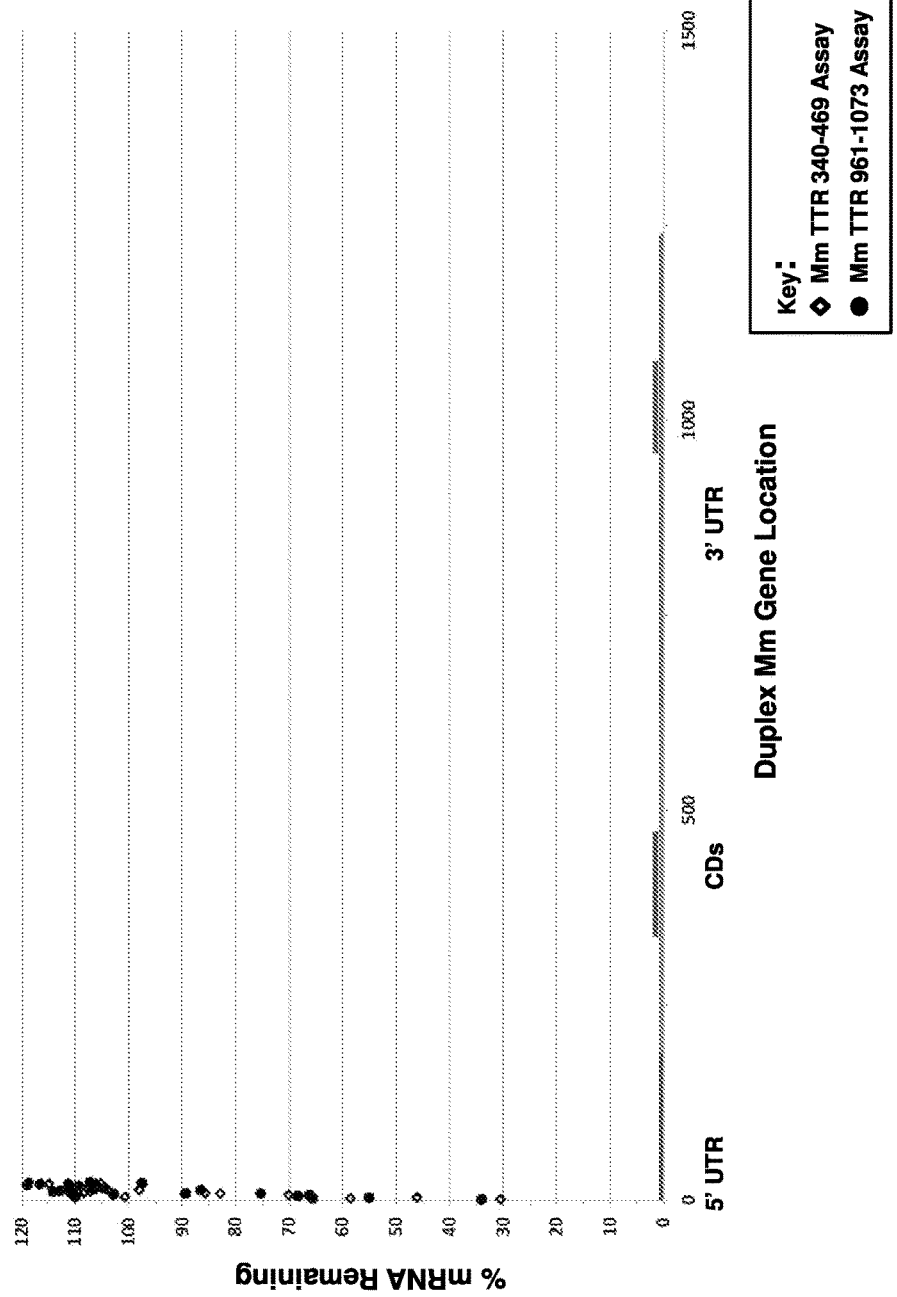
Figure 3B:
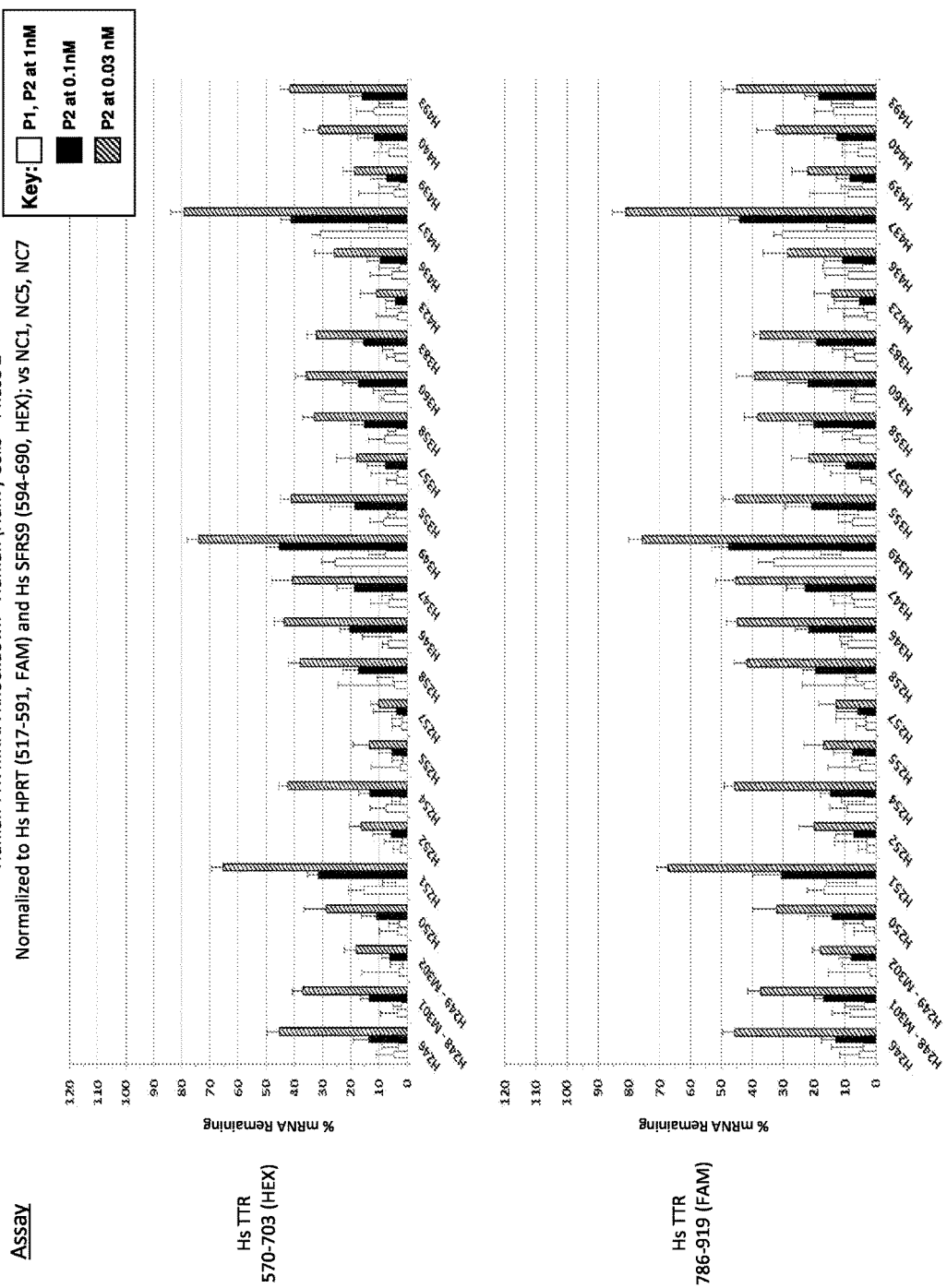
Figure 4A:
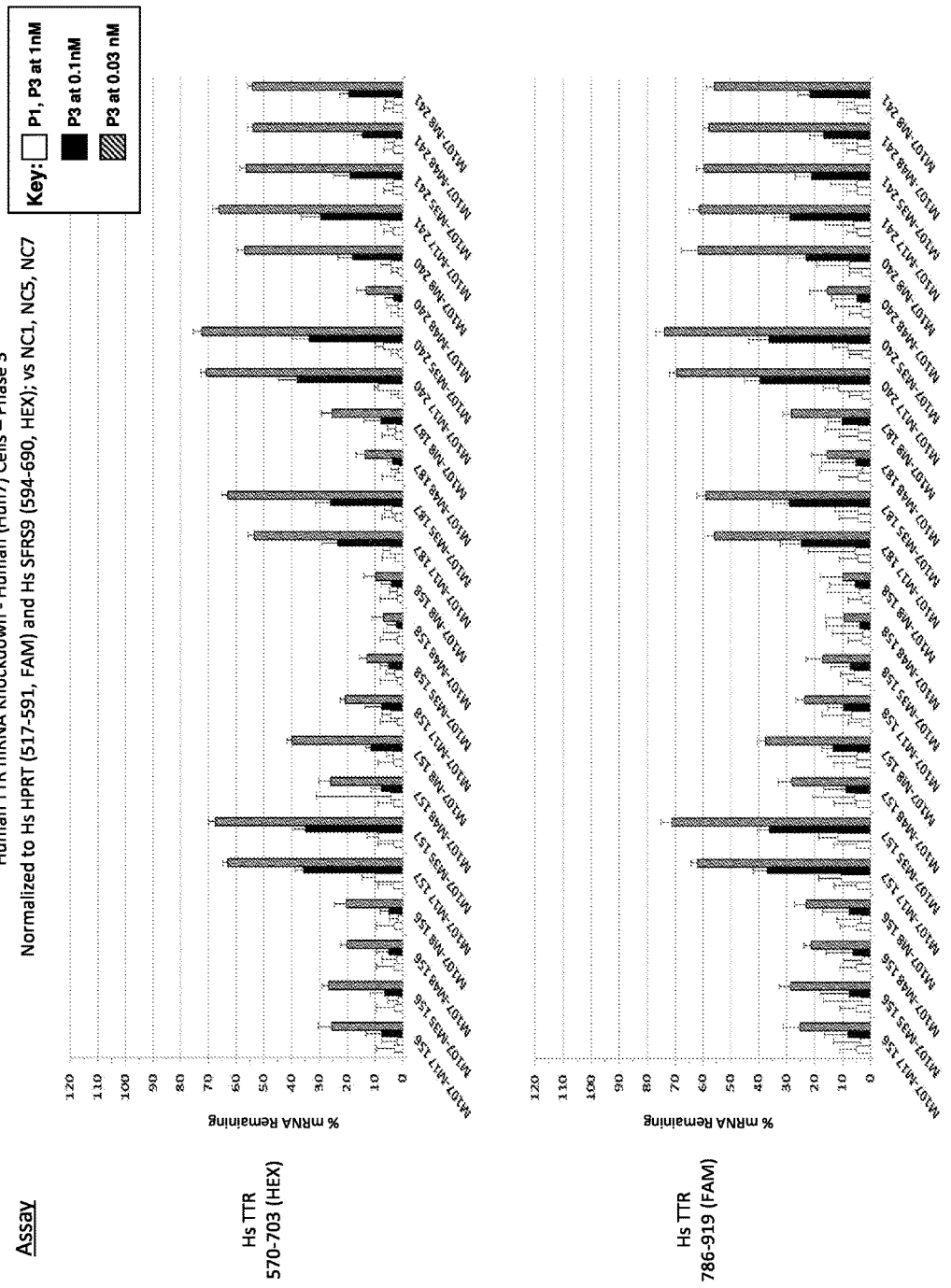
Figure 4D:
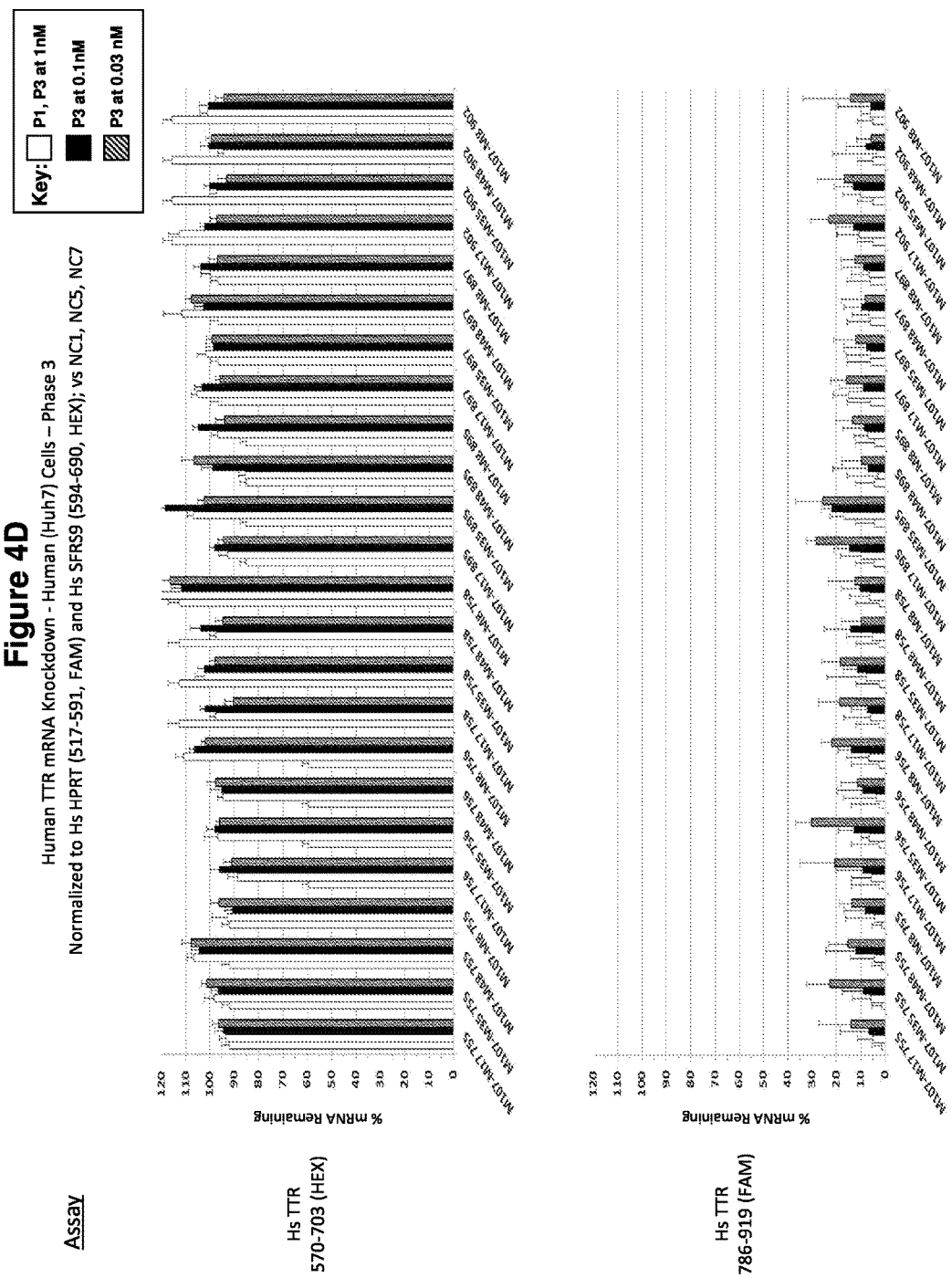
Figure 5C:
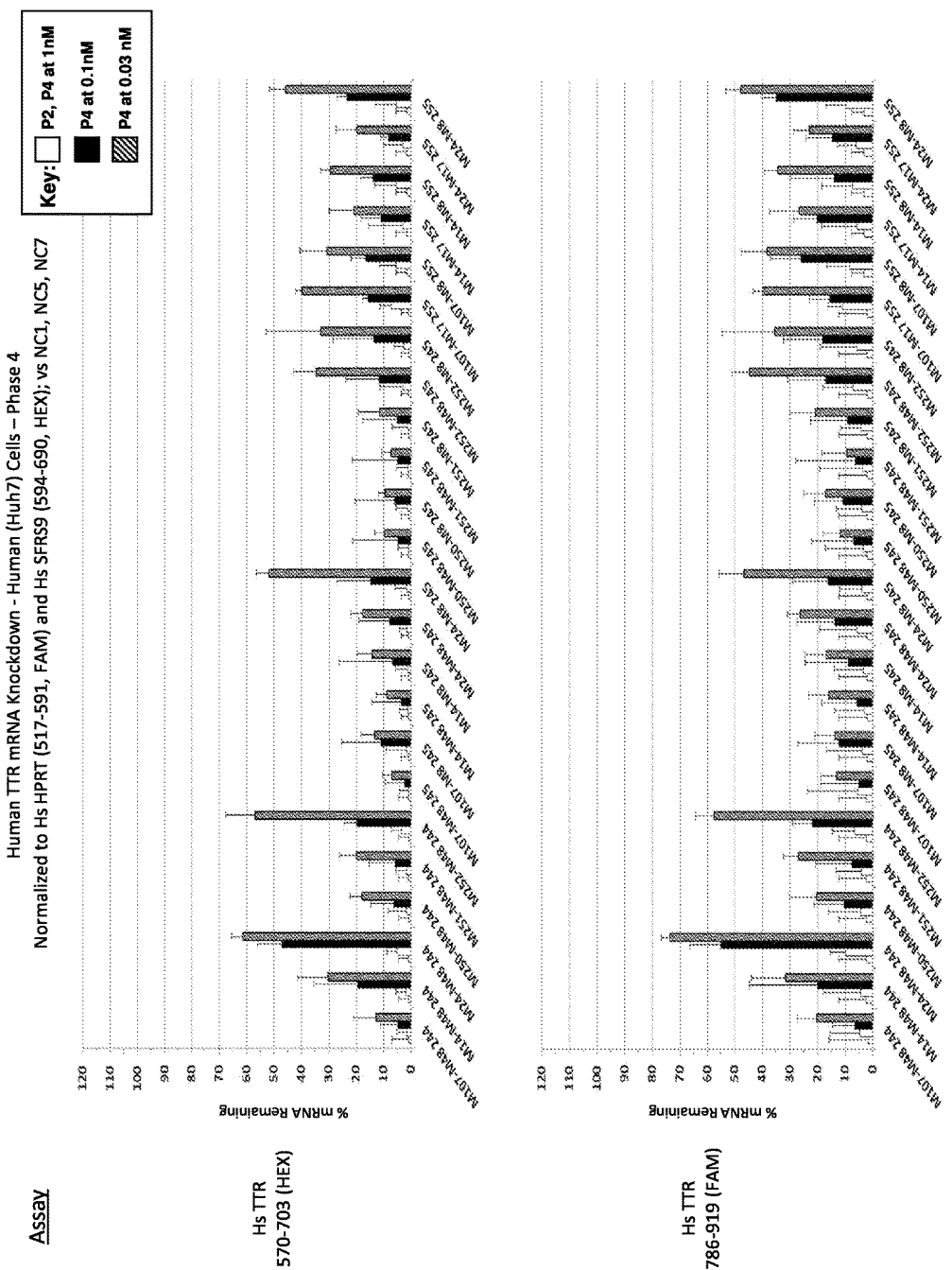

The present invention is directed to compositions that contain nucleic acids, for example double stranded RNA ("dsRNA"), and methods for preparing them, that are capable of reducing the level and/or expression of the transthyretin gene in vivo or in vitro. One of the strands of the dsRNA contains a region of nucleotide sequence that has a length that ranges from 19 to 35 nucleotides that can direct the destruction and/or translational inhibition of the targeted transthyretin transcript.

Definitions

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

The present invention features one or more DsiRNA molecules that can modulate (e.g., inhibit) transthyretin expression. The DsiRNAs of the invention optionally can be used in combination with modulators of other genes and/or gene products associated with the maintenance or development of diseases or disorders associated with transthyretin misregulation (e.g., tumor formation and/or growth, etc.). The DsiRNA agents of the invention modulate transthyretin RNAs such as those corresponding to the cDNA sequences referred to by GenBank Accession Nos. NM_000371.3 (human transthyretin) and NM_013697.5 (mouse transthyretin), which are referred to herein generally as "transthyretin."

The below description of the various aspects and embodiments of the invention is provided with reference to exemplary transthyretin RNAs, generally referred to herein as transthyretin. However, such reference is meant to be exemplary only and the various aspects and embodiments of the invention are also directed to alternate transthyretin RNAs, such as mutant transthyretin RNAs or additional transthyretin splice variants. Certain aspects and embodiments are also directed to other genes involved in transthyretin pathways, including genes whose misregulation acts in association with that of transthyretin (or is affected or affects transthyretin regulation) to produce phenotypic effects that may be targeted for treatment (e.g., tumor formation and/or growth, etc.). BAK1, Noxa, BCL2L11, Bcl-2-associated death promoter, PCNA, DAD1, TNKS and BH3 interacting domain death agonist are examples of genes that interact with transthyretin. Such additional genes, including those of pathways that act in coordination with transthyretin, can be targeted using dsRNA and the methods described herein for use of transthyretin-targeting dsRNAs. Thus, the inhibition and the effects of such inhibition of the other genes can be performed as described herein.

The term "transthyretin" refers to nucleic acid sequences encoding a transthyretin protein, peptide, or polypeptide (e.g., transthyretin transcripts, such as the sequences of transthyretin Genbank Accession Nos. NM_000371.3 and NM_013697.5). In certain embodiments, the term "transthyretin" is also meant to include other transthyretin encoding sequence, such as other transthyretin isoforms, mutant transthyretin genes, splice variants of transthyretin genes, and transthyretin gene polymorphisms. The term "transthyretin"

is also used to refer to the polypeptide gene product of an transthyretin gene/transript, e.g., an transthyretin protein, peptide, or polypeptide, such as those encoded by transthyretin Genbank Accession Nos. NP_000362.1 and NP_038725.1.

As used herein, a "transthyretin-associated disease or disorder" refers to a disease or disorder known in the art to be associated with altered transthyretin expression, level and/or activity. Notably, a "transthyretin-associated disease or disorder" includes diseases or disorders of the liver and other organs including, but not limited to, TTR amyloidosis, e.g., familial amyloidotic polyneuropathy (FAP), familial amyloidotic cardiomyopathy (FAC) and leptomeningeal/CNS (Central Nervous System) amyloidosis.

In certain embodiments, dsRNA-mediated inhibition of a transthyretin target sequence is assessed. In such embodiments, transthyretin RNA levels can be assessed by art-recognized methods (e.g., RT-PCR, Northern blot, expression array, etc.), optionally via comparison of transthyretin levels in the presence of an anti-transthyretin dsRNA of the invention relative to the absence of such an anti-transthyretin dsRNA. In certain embodiments, transthyretin levels in the presence of an anti-transthyretin dsRNA are compared to those observed in the presence of vehicle alone, in the presence of a dsRNA directed against an unrelated target RNA, or in the absence of any treatment.

It is also recognized that levels of transthyretin protein can be assessed and that transthyretin protein levels are, under different conditions, either directly or indirectly related to transthyretin RNA levels and/or the extent to which a dsRNA inhibits transthyretin expression, thus art-recognized methods of assessing transthyretin protein levels (e.g., Western blot, immunoprecipitation, other antibody-based methods, etc.) can also be employed to examine the inhibitory effect of a dsRNA of the invention.

An anti-transthyretin dsRNA of the invention is deemed to possess "transthyretin inhibitory activity" if a statistically significant reduction in transthyretin RNA (or when the transthyretin protein is assessed, transthyretin protein levels) is seen when an anti-transthyretin dsRNA of the invention is administered to a system (e.g., cell-free in vitro system), cell, tissue or organism, as compared to a selected control. The distribution of experimental values and the number of replicate assays performed will tend to dictate the parameters of what levels of reduction in transthyretin RNA (either as a % or in absolute terms) is deemed statistically significant (as assessed by standard methods of determining statistical significance known in the art). However, in certain embodiments, "transthyretin inhibitory activity" is defined based upon a % or absolute level of reduction in the level of transthyretin in a system, cell, tissue or organism. For example, in certain embodiments, a dsRNA of the invention is deemed to possess transthyretin inhibitory activity if at least a 5% reduction or at least a 10% reduction in transthyretin RNA is observed in the presence of a dsRNA of the invention relative to transthyretin levels seen for a suitable control. (For example, in vivo transthyretin levels in a tissue and/or subject can, in certain embodiments, be deemed to be inhibited by a dsRNA agent of the invention if, e.g., a 5% or 10% reduction in transthyretin levels is observed relative to a control.) In certain other embodiments, a dsRNA of the invention is deemed to possess transthyretin inhibitory activity if transthyretin RNA levels are observed to be reduced by at least 15% relative to a selected control, by at least 20% relative to a selected control, by at least 25% relative to a selected control, by at least 30% relative to a selected control, by at least 35% relative to a selected control, by at least 40% relative to a selected control, by at least 45% relative to a selected control, by at least 50% relative to a selected control, by at least 55% relative to a selected control, by at least 60% relative to a selected control, by at least 65% relative to a selected control, by at least 70% relative to a selected control, by at least 75% relative to a selected control, by at least 80% relative to a selected control, by at least 85% relative to a selected control, by at least 90% relative to a selected control, by at least 95% relative to a selected control, by at least 96% relative to a selected control, by at least 97% relative to a selected control, by at least 98% relative to a selected control or by at least 99% relative to a selected control. In some embodiments, complete inhibition of transthyretin is required for a dsRNA to be deemed to possess transthyretin inhibitory activity. In certain models (e.g., cell culture), a dsRNA is deemed to possess transthyretin inhibitory activity if at least a 50% reduction in transthyretin levels is observed relative to a suitable control. In certain other embodiments, a dsRNA is deemed to possess transthyretin inhibitory activity if at least an 80% reduction in transthyretin levels is observed relative to a suitable control.

By way of specific example, in Example 2 below, a series of DsiRNAs targeting transthyretin were tested for the ability to reduce transthyretin mRNA levels in human Huh7 or mouse AML12 cells in vitro, at 1 nM concentrations in the environment of such cells and in the presence of a transfection agent (Lipofectamine™ RNAiMAX, Invitrogen). Within Example 2 below, transthyretin inhibitory activity was ascribed to those DsiRNAs that were observed to effect at least a 50% reduction of transthyretin mRNA levels under the assayed conditions. It is contemplated that transthyretin inhibitory activity could also be attributed to a dsRNA under either more or less stringent conditions than those employed for Example 2 below, even when the same or a similar assay and conditions are employed. For example, in certain embodiments, a tested dsRNA of the invention is deemed to possess transthyretin inhibitory activity if at least a 10% reduction, at least a 20% reduction, at least a 30% reduction, at least a 40% reduction, at least a 50% reduction, at least a 60% reduction, at least a 70% reduction, at least a 75% reduction, at least an 80% reduction, at least an 85% reduction, at least a 90% reduction, or at least a 95% reduction in transthyretin mRNA levels is observed in a mammalian cell line in vitro at 1 nM dsRNA concentration or lower in the environment of a cell, relative to a suitable control.

Use of other endpoints for determination of whether a double stranded RNA of the invention possesses transthyretin inhibitory activity is also contemplated. Specfically, in one embodiment, in addition to or as an alternative to assessing transthyretin mRNA levels, the ability of a tested dsRNA to reduce transthyretin protein levels (e.g., at 48 hours after contacting a mammalian cell in vitro or in vivo) is assessed, and a tested dsRNA is deemed to possess transthyretin inhibitory activity if at least a 10% reduction, at least a 20% reduction, at least a 30% reduction, at least a 40% reduction, at least a 50% reduction, at least a 60% reduction, at least a 70% reduction, at least a 75% reduction, at least an 80% reduction, at least an 85% reduction, at least a 90% reduction, or at least a 95% reduction in transthyretin protein levels is observed in a mammalian cell contacted with the assayed double stranded RNA in vitro or in vivo, relative to a suitable control. Additional endpoints contemplated include, e.g., assessment of a phenotype associated with reduction of transthyretin levels—e.g., reduction of phenotypes associated with elevated levels of TTR deposits throughout the body.

Transthyretin inhibitory activity can also be evaluated over time (duration) and over concentration ranges (potency), with assessment of what constitutes a dsRNA possessing transthyretin inhibitory activity adjusted in accordance with concentrations administered and duration of time following administration. Thus, in certain embodiments, a dsRNA of the invention is deemed to possess transthyretin inhibitory activity if at least a 50% reduction in transthyretin activity is observed/persists at a duration of time of 2 hours, 5 hours, 10 hours, 1 day, 2 days, 3 days, 4 days, 5 days, 6 days, 7 days, 8 days, 9 days, 10 days or more after administration of the dsRNA to a cell or organism. In additional embodiments, a dsRNA of the invention is deemed to be a potent transthyretin inhibitory agent if transthyretin inhibitory activity (e.g., in certain embodiments, at least 50% inhibition of transthyretin) is observed at a concentration of 1 nM or less, 500 pM or less, 200 pM or less, 100 pM or less, 50 pM or less, 20 pM or less, 10 pM or less, 5 pM or less, 2 pM or less or even 1 pM or less in the environment of a cell, for example, within an in vitro assay for transthyretin inhibitory activity as described herein. In certain embodiments, a potent transthyretin inhibitory dsRNA of the invention is defined as one that is capable of transthyretin inhibitory activity (e.g., in certain embodiments, at least 20% reduction of transthyretin levels) at a formulated concentration of 10 mg/kg or less when administered to a subject in an effective delivery vehicle (e.g., an effective lipid nanoparticle formulation). Preferably, a potent transthyretin inhibitory dsRNA of the invention is defined as one that is capable of transthyretin inhibitory activity (e.g., in certain embodiments, at least 50% reduction of transthyretin levels) at a formulated concentration of 5 mg/kg or less when administered to a subject in an effective delivery vehicle. More preferably, a potent transthyretin inhibitory dsRNA of the invention is defined as one that is capable of transthyretin inhibitory activity (e.g., in certain embodiments, at least 50% reduction of transthyretin levels) at a formulated concentration of 5 mg/kg or less when administered to a subject in an effective delivery vehicle. Optionally, a potent transthyretin inhibitory dsRNA of the invention is defined as one that is capable of transthyretin inhibitory activity (e.g., in certain embodiments, at least 50% reduction of transthyretin levels) at a formulated concentration of 2 mg/kg or less, or even 1 mg/kg or less, when administered to a subject in an effective delivery vehicle.

In certain embodiments, potency of a dsRNA of the invention is determined in reference to the number of copies of a dsRNA present in the cytoplasm of a target cell that are required to achieve a certain level of target gene knockdown. For example, in certain embodiments, a potent dsRNA is one capable of causing 50% or greater knockdown of a target mRNA when present in the cytoplasm of a target cell at a copy number of 1000 or fewer RISC-loaded antisense strands per cell. More preferably, a potent dsRNA is one capable of producing 50% or greater knockdown of a target mRNA when present in the cytoplasm of a target cell at a copy number of 500 or fewer RISC-loaded antisense strands per cell. Optionally, a potent dsRNA is one capable of producing 50% or greater knockdown of a target mRNA when present in the cytoplasm of a target cell at a copy number of 300 or fewer RISC-loaded antisense strands per cell.

In further embodiments, the potency of a DsiRNA of the invention can be defined in reference to a 19 to 23 mer dsRNA directed to the same target sequence within the same target gene. For example, a DsiRNA of the invention that possesses enhanced potency relative to a corresponding 19 to 23 mer dsRNA can be a DsiRNA that reduces a target gene by an additional 5% or more, an additional 10% or more, an additional 20% or more, an additional 30% or more, an additional 40% or more, or an additional 50% or more as compared to a corresponding 19 to 23 mer dsRNA, when assayed in an in vitro assay as described herein at a sufficiently low concentration to allow for detection of a potency difference (e.g., transfection concentrations at or below 1 nM in the environment of a cell, at or below 100 pM in the environment of a cell, at or below 10 pM in the environment of a cell, at or below 1 nM in the environment of a cell, in an in vitro assay as described herein; notably, it is recognized that potency differences can be best detected via performance of such assays across a range of concentrations—e.g., 0.1 pM to 10 nM—for purpose of generating a dose-response curve and identifying an $IC_{50}$ value associated with a DsiRNA/dsRNA).

Transthyretin inhibitory levels and/or transthyretin levels may also be assessed indirectly, e.g., measurement of a reduction of amyloidosis phenotype(s) in a subject may be used to assess transthyretin levels and/or transthyretin inhibitory efficacy of a double-stranded nucleic acid of the instant invention.

In certain embodiments, the phrase "consists essentially of" is used in reference to the anti-transthyretin dsRNAs of the invention. In some such embodiments, "consists essentially of" refers to a composition that comprises a dsRNA of the invention which possesses at least a certain level of transthyretin inhibitory activity (e.g., at least 50% transthyretin inhibitory activity) and that also comprises one or more additional components and/or modifications that do not significantly impact the transthyretin inhibitory activity of the dsRNA. For example, in certain embodiments, a composition "consists essentially of" a dsRNA of the invention where modifications of the dsRNA of the invention and/or dsRNA-associated components of the composition do not alter the transthyretin inhibitory activity (optionally including potency or duration of transthyretin inhibitory activity) by greater than 3%, greater than 5%, greater than 10%, greater than 15%, greater than 20%, greater than 25%, greater than 30%, greater than 35%, greater than 40%, greater than 45%, or greater than 50% relative to the dsRNA of the invention in isolation. In certain embodiments, a composition is deemed to consist essentially of a dsRNA of the invention even if more dramatic reduction of transthyretin inhibitory activity (e.g., 80% reduction, 90% reduction, etc. in efficacy, duration and/or potency) occurs in the presence of additional components or modifications, yet where transthyretin inhibitory activity is not significantly elevated (e.g., observed levels of transthyretin inhibitory activity are within 10% those observed for the isolated dsRNA of the invention) in the presence of additional components and/or modifications.

As used herein, the term "nucleic acid" refers to deoxyribonucleotides, ribonucleotides, or modified nucleotides, and polymers thereof in single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs) and unlocked nucleic acids (UNAs; see, e.g., Jensen et al. *Nucleic Acids Symposium Series* 52: 133-4), and derivatives thereof.

As used herein, "nucleotide" is used as recognized in the art to include those with natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, e.g., Usman and McSwiggen, supra; Eckstein, et al., International PCT Publication No. WO 92/07065; Usman et al, International PCT Publication No. WO 93/15187; Uhlman & Peyman, supra, all are hereby incorporated by reference herein). There are several examples of modified nucleic acid bases known in the art as summarized by Limbach, et al, *Nucleic Acids Res.* 22:2183, 1994. Some of the non-limiting examples of base modifications that can be introduced into nucleic acid molecules include, hypoxanthine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin, et al., Biochemistry 35:14090, 1996; Uhlman & Peyman, supra). By "modified bases" in this aspect is meant nucleotide bases other than adenine, guanine, cytosine and uracil at 1' position or their equivalents.

As used herein, "modified nucleotide" refers to a nucleotide that has one or more modifications to the nucleoside, the nucleobase, pentose ring, or phosphate group. For example, modified nucleotides exclude ribonucleotides containing adenosine monophosphate, guanosine monophosphate, uridine monophosphate, and cytidine monophosphate and deoxyribonucleotides containing deoxyadenosine monophosphate, deoxyguanosine monophosphate, deoxythymidine monophosphate, and deoxycytidine monophosphate. Modifications include those naturally occuring that result from modification by enzymes that modify nucleotides, such as methyltransferases. Modified nucleotides also include synthetic or non-naturally occurring nucleotides. Synthetic or non-naturally occurring modifications in nucleotides include those with 2' modifications, e.g., 2'-methoxyethoxy, 2'-fluoro, 2'-allyl, 2'-O-[2-(methylamino)-2-oxoethyl], 4'-thio, 4'-CH$_2$—O-2'-bridge, 4'-(CH$_2$)$_2$—O-2'-bridge, 2'-LNA or other bicyclic or "bridged" nucleoside analog, and 2'-O—(N-methylcarbamate) or those comprising base analogs. In connection with 2'-modified nucleotides as described for the present disclosure, by "amino" is meant 2'-NH$_2$ or 2'-O—NH$_2$, which can be modified or unmodified. Such modified groups are described, e.g., in Eckstein et al., U.S. Pat. No. 5,672,695 and Matulic-Adamic et al., U.S. Pat. No. 6,248,878. "Modified nucleotides" of the instant invention can also include nucleotide analogs as described above.

In reference to the nucleic acid molecules of the present disclosure, modifications may exist upon these agents in patterns on one or both strands of the double stranded ribonucleic acid (dsRNA). As used herein, "alternating positions" refers to a pattern where every other nucleotide is a modified nucleotide or there is an unmodified nucleotide (e.g., an unmodified ribonucleotide) between every modified nucleotide over a defined length of a strand of the dsRNA (e.g., 5'-MNMNMN-3'; 3'-MNMNMN-5'; where M is a modified nucleotide and N is an unmodified nucleotide). The modification pattern starts from the first nucleotide position at either the 5' or 3' terminus according to a position numbering convention, e.g., as described herein (in certain embodiments, position 1 is designated in reference to the terminal residue of a strand following a projected Dicer cleavage event of a DsiRNA agent of the invention; thus, position 1 does not always constitute a 3' terminal or 5' terminal residue of a pre-processed agent of the invention). The pattern of modified nucleotides at alternating positions may run the full length of the strand, but in certain embodiments includes at least 4, 6, 8, 10, 12, 14 nucleotides containing at least 2, 3, 4, 5, 6 or 7 modified nucleotides, respectively. As used herein, "alternating pairs of positions" refers to a pattern where two consecutive modified nucleotides are separated by two consecutive unmodified nucleotides over a defined length of a strand of the dsRNA (e.g., 5'-MMNNMMNNMMNN-3'; 3'-MMNNMMNNMMNN-5'; where M is a modified nucleotide and N is an unmodified nucleotide). The modification pattern starts from the first nucleotide position at either the 5' or 3' terminus according to a position numbering convention such as those described herein. The pattern of modified nucleotides at alternating positions may run the full length of the strand, but preferably includes at least 8, 12, 16, 20, 24, 28 nucleotides containing at least 4, 6, 8, 10, 12 or 14 modified nucleotides, respectively. It is emphasized that the above modification patterns are exemplary and are not intended as limitations on the scope of the invention.

As used herein, "base analog" refers to a heterocyclic moiety which is located at the 1' position of a nucleotide sugar moiety in a modified nucleotide that can be incorporated into a nucleic acid duplex (or the equivalent position in a nucleotide sugar moiety substitution that can be incorporated into a nucleic acid duplex). In the dsRNAs of the invention, a base analog is generally either a purine or pyrimidine base excluding the common bases guanine (G), cytosine (C), adenine (A), thymine (T), and uracil (U). Base analogs can duplex with other bases or base analogs in dsRNAs. Base analogs include those useful in the compounds and methods of the invention, e.g., those disclosed in U.S. Pat. Nos. 5,432,272 and 6,001,983 to Benner and US Patent Publication No. 20080213891 to Manoharan, which are herein incorporated by reference. Non-limiting examples of bases include hypoxanthine (I), xanthine (X), 3β-D-ribofuranosyl-(2,6-diaminopyrimidine) (K), 3-β-D-ribofuranosyl-(1-methyl-pyrazolo[4,3-d]pyrimidine-5,7(4H,6H)-dione) (P), iso-cytosine (iso-C), iso-guanine (iso-G), 1-β-D-ribofuranosyl-(5-nitroindole), 1-β-D-ribofuranosyl-(3-nitropyrrole), 5-bromouracil, 2-aminopurine, 4-thio-dT, 7-(2-thienyl)-imidazo[4,5-b]pyridine (Ds) and pyrrole-2-carbaldehyde (Pa), 2-amino-6-(2-thienyl)purine (S), 2-oxopyridine (Y), difluorotolyl, 4-fluoro-6-methylbenzimidazole, 4-methylbenzimidazole, 3-methyl isocarbostyrilyl, 5-methyl isocarbostyrilyl, and 3-methyl-7-propynyl isocarbostyrilyl, 7-azaindolyl, 6-methyl-7-azaindolyl, imidizopyridinyl, 9-methyl-imidizopyridinyl, pyrrolopyrizinyl, isocarbostyrilyl, 7-propynyl isocarbostyrilyl, propynyl-7-azaindolyl, 2,4,5-trimethylphenyl, 4-methylindolyl, 4,6-dimethylindolyl, phenyl, napthalenyl, anthracenyl, phenanthracenyl, pyrenyl, stilbenzyl, tetracenyl, pentacenyl, and structural derivates thereof (Schweitzer et al., J. Org. Chem., 59:7238-7242 (1994); Berger et al., Nucleic Acids Research, 28(15):2911-2914 (2000); Moran et al., J. Am. Chem. Soc., 119:2056-2057 (1997); Morales et al., J. Am. Chem. Soc., 121:2323-2324 (1999); Guckian et al., J. Am. Chem. Soc., 118:8182-8183 (1996); Morales et al., J. Am. Chem. Soc., 122(6):1001-1007 (2000); McMinn et al., J. Am. Chem. Soc., 121:11585-11586 (1999); Guckian et al., J. Org. Chem., 63:9652-9656 (1998); Moran et al., Proc. Natl. Acad. Sci., 94:10506-10511 (1997); Das et al., J. Chem. Soc., Perkin Trans., 1:197-206 (2002); Shibata et al., J. Chem. Soc., Perkin Trans., 1: 1605-1611 (2001); Wu et al., J. Am. Chem. Soc., 122(32):7621-7632 (2000); O'Neill et al., J. Org. Chem., 67:5869-5875 (2002); Chaudhuri et al., J. Am. Chem. Soc., 117:10434-10442 (1995); and U.S. Pat. No. 6,218,108). Base analogs may also be a universal base.

As used herein, "universal base" refers to a heterocyclic moiety located at the 1' position of a nucleotide sugar moiety in a modified nucleotide, or the equivalent position in a nucleotide sugar moiety substitution, that, when present in a nucleic acid duplex, can be positioned opposite more than one type of base without altering the double helical structure (e.g., the structure of the phosphate backbone). Additionally, the universal base does not destroy the ability of the single stranded nucleic acid in which it resides to duplex to a target nucleic acid. The ability of a single stranded nucleic acid containing a universal base to duplex a target nucleic can be assayed by methods apparent to one in the art (e.g., UV absorbance, circular dichroism, gel shift, single stranded nuclease sensitivity, etc.). Additionally, conditions under which duplex formation is observed may be varied to determine duplex stability or formation, e.g., temperature, as melting temperature (Tm) correlates with the stability of nucleic acid duplexes. Compared to a reference single stranded nucleic acid that is exactly complementary to a target nucleic acid, the single stranded nucleic acid containing a universal base forms a duplex with the target nucleic acid that has a lower Tm than a duplex formed with the complementary nucleic acid. However, compared to a reference single stranded nucleic acid in which the universal base has been replaced with a base to generate a single mismatch, the single stranded nucleic acid containing the universal base forms a duplex with the target nucleic acid that has a higher Tm than a duplex formed with the nucleic acid having the mismatched base.

Some universal bases are capable of base pairing by forming hydrogen bonds between the universal base and all of the bases guanine (G), cytosine (C), adenine (A), thymine (T), and uracil (U) under base pair forming conditions. A universal base is not a base that forms a base pair with only one single complementary base. In a duplex, a universal base may form no hydrogen bonds, one hydrogen bond, or more than one hydrogen bond with each of G, C, A, T, and U opposite to it on the opposite strand of a duplex. Preferably, the universal bases does not interact with the base opposite to it on the opposite strand of a duplex. In a duplex, base pairing between a universal base occurs without altering the double helical structure of the phosphate backbone. A universal base may also interact with bases in adjacent nucleotides on the same nucleic acid strand by stacking interactions. Such stacking interactions stabilize the duplex, especially in situations where the universal base does not form any hydrogen bonds with the base positioned opposite to it on the opposite strand of the duplex. Non-limiting examples of universal-binding nucleotides include inosine, 1-β-D-ribofuranosyl-5-nitroindole, and/or 1-β-D-ribofuranosyl-3-nitropyrrole (US Pat. Appl. Publ. No. 20070254362 to Quay et al.; Van Aerschot et al., An acyclic 5-nitroindazole nucleoside analogue as ambiguous nucleoside. Nucleic Acids Res. 1995 Nov. 11; 23(21):4363-70; Loakes et al., 3-Nitropyrrole and 5-nitroindole as universal bases in primers for DNA sequencing and PCR. Nucleic Acids Res. 1995 Jul. 11; 23(13):2361-6; Loakes and Brown, 5-Nitroindole as an universal base analogue. Nucleic Acids Res. 1994 Oct. 11; 22(20):4039-43).

As used herein, "loop" refers to a structure formed by a single strand of a nucleic acid, in which complementary regions that flank a particular single stranded nucleotide region hybridize in a way that the single stranded nucleotide region between the complementary regions is excluded from duplex formation or Watson-Crick base pairing. A loop is a single stranded nucleotide region of any length. Examples of loops include the unpaired nucleotides present in such structures as hairpins, stem loops, or extended loops.

As used herein, "extended loop" in the context of a dsRNA refers to a single stranded loop and in addition 1, 2, 3, 4, 5, 6 or up to 20 base pairs or duplexes flanking the loop. In an extended loop, nucleotides that flank the loop on the 5' side form a duplex with nucleotides that flank the loop on the 3' side. An extended loop may form a hairpin or stem loop.

As used herein, "tetraloop" in the context of a dsRNA refers to a loop (a single stranded region) consisting of four nucleotides that forms a stable secondary structure that contributes to the stability of adjacent Watson-Crick hybridized nucleotides. Without being limited to theory, a tetraloop may stabilize an adjacent Watson-Crick base pair by stacking interactions. In addition, interactions among the four nucleotides in a tetraloop include but are not limited to non-Watson-Crick base pairing, stacking interactions, hydrogen bonding, and contact interactions (Cheong et al., *Nature* 1990 Aug. 16; 346(6285):680-2; Heus and Pardi, *Science* 1991 Jul. 12; 253(5016):191-4). A tetraloop confers an increase in the melting temperature (Tm) of an adjacent duplex that is higher than expected from a simple model loop sequence consisting of four random bases. For example, a tetraloop can confer a melting temperature of at least 55° C. in 10 mM $NaHPO_4$ to a hairpin comprising a duplex of at least 2 base pairs in length. A tetraloop may contain ribonucleotides, deoxyribonucleotides, modified nucleotides, and combinations thereof. Examples of RNA tetraloops include the UNCG family of tetraloops (e.g., UUCG), the GNRA family of tetraloops (e.g., GAAA), and the CUUG tetraloop. (Woese et al., Proc Natl Acad Sci USA. 1990 November; 87(21):8467-71; Antao et al., Nucleic Acids Res. 1991 Nov. 11; 19(21):5901-5). Examples of DNA tetraloops include the d(GNNA) family of tetraloops (e.g., d(GTTA), the d(GNRA)) family of tetraloops, the d(GNAB) family of tetraloops, the d(CNNG) family of tetraloops, the d(TNCG) family of tetraloops (e.g., d(TTCG)). (Nakano et al. Biochemistry, 41 (48), 14281-14292, 2002; SHINJI et al. Nippon Kagakkai Koen Yokoshu VOL. 78th; NO. 2; PAGE. 731 (2000).)

As used herein, the term "siRNA" refers to a double stranded nucleic acid in which each strand comprises RNA, RNA analog(s) or RNA and DNA. The siRNA comprises between 19 and 23 nucleotides or comprises 21 nucleotides. The siRNA typically has 2 bp overhangs on the 3' ends of each strand such that the duplex region in the siRNA comprises 17-21 nucleotides, or 19 nucleotides. Typically, the antisense strand of the siRNA is sufficiently complementary with the target sequence of the transthyretin gene/ RNA.

In certain embodiments, an anti-transthyretin DsiRNA of the instant invention possesses strand lengths of at least 25 nucleotides. Accordingly, in certain embodiments, an anti-transthyretin DsiRNA contains one oligonucleotide sequence, a first sequence, that is at least 25 nucleotides in length and no longer than 35 or up to 50 or more nucleotides. This sequence of RNA can be between 26 and 35, 26 and 34, 26 and 33, 26 and 32, 26 and 31, 26 and 30, and 26 and 29 nucleotides in length. This sequence can be 27 or 28 nucleotides in length or 27 nucleotides in length. The second sequence of the DsiRNA agent can be a sequence that anneals to the first sequence under biological conditions, such as within the cytoplasm of a eukaryotic cell. Generally, the second oligonucleotide sequence will have at least 19 complementary base pairs with the first oligonucleotide sequence, more typically the second oligonucleotide sequence will have 21 or more complementary base pairs, or 25 or more complementary base pairs with the first oligonucleotide sequence. In one embodiment, the second sequence is the same length as the first sequence, and the DsiRNA agent is blunt ended. In another embodiment, the ends of the DsiRNA agent have one or more overhangs.

In certain embodiments, the first and second oligonucleotide sequences of the DsiRNA agent exist on separate oligonucleotide strands that can be and typically are chemically synthesized. In some embodiments, both strands are between 26 and 35 nucleotides in length. In other embodiments, both strands are between 25 and 30 or 26 and 30 nucleotides in length. In one embodiment, both strands are 27 nucleotides in length, are completely complementary and have blunt ends. In certain embodiments of the instant invention, the first and second sequences of an anti-transthyretin DsiRNA exist on separate RNA oligonucleotides (strands). In one embodiment, one or both oligonucleotide strands are capable of serving as a substrate for Dicer. In other embodiments, at least one modification is present that promotes Dicer to bind to the double-stranded RNA structure in an orientation that maximizes the double-stranded RNA structure's effectiveness in inhibiting gene expression. In certain embodiments of the instant invention, the anti-transthyretin DsiRNA agent is comprised of two oligonucleotide strands of differing lengths, with the anti-transthyretin DsiRNA possessing a blunt end at the 3' terminus of a first strand (sense strand) and a 3' overhang at the 3' terminus of a second strand (antisense strand). The DsiRNA can also contain one or more deoxyribonucleic acid (DNA) base substitutions.

Suitable DsiRNA compositions that contain two separate oligonucleotides can be chemically linked outside their annealing region by chemical linking groups. Many suitable chemical linking groups are known in the art and can be used. Suitable groups will not block Dicer activity on the DsiRNA and will not interfere with the directed destruction of the RNA transcribed from the target gene. Alternatively, the two separate oligonucleotides can be linked by a third oligonucleotide such that a hairpin structure is produced upon annealing of the two oligonucleotides making up the DsiRNA composition. The hairpin structure will not block Dicer activity on the DsiRNA and will not interfere with the directed destruction of the target RNA.

The dsRNA molecule can be designed such that every residue of the antisense strand is complementary to a residue in the target molecule. Alternatively, substitutions can be made within the molecule to increase stability and/or enhance processing activity of said molecule. Substitutions can be made within the strand or can be made to residues at the ends of the strand. In certain embodiments, substitutions and/or modifications are made at specific residues within a DsiRNA agent. Such substitutions and/or modifications can include, e.g., deoxy-modifications at one or more residues of positions 1, 2 and 3 when numbering from the 3' terminal position of the sense strand of a DsiRNA agent; and introduction of 2'-O-alkyl (e.g., 2'-O-methyl) modifications at the 3' terminal residue of the antisense strand of DsiRNA agents, with such modifications also being performed at overhang positions of the 3' portion of the antisense strand and at alternating residues of the antisense strand of the DsiRNA that are included within the region of a DsiRNA agent that is processed to form an active siRNA agent. The preceding modifications are offered as exemplary, and are not intended to be limiting in any manner. Further consideration of the structure of preferred DsiRNA agents, including further description of the modifications and substitutions that can be performed upon the anti-transthyretin DsiRNA agents of the instant invention, can be found below.

Where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes of the invention.

The term "double-stranded RNA" or "dsRNA", as used herein, refers to a complex of ribonucleic acid molecules, having a duplex structure comprising two anti-parallel and substantially complementary, as defined above, nucleic acid strands. The two strands forming the duplex structure may be different portions of one larger RNA molecule, or they may be separate RNA molecules. Where separate RNA molecules, such dsRNA are often referred to as siRNA ("short interfering RNA") or DsiRNA ("Dicer substrate siRNAs"). Where the two strands are part of one larger molecule, and therefore are connected by an uninterrupted chain of nucleotides between the 3'-end of one strand and the 5' end of the respective other strand forming the duplex structure, the connecting RNA chain is referred to as a "hairpin loop", "short hairpin RNA" or "shRNA". Where the two strands are connected covalently by means other than an uninterrupted chain of nucleotides between the 3'-end of one strand and the 5' end of the respective other strand forming the duplex structure, the connecting structure is referred to as a "linker". The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. In addition, as used herein, "dsRNA" may include chemical modifications to ribonucleotides, internucleoside linkages, end-groups, caps, and conjugated moieties, including substantial modifications at multiple nucleotides and including all types of modifications disclosed herein or known in the art. Any such modifications, as used in an siRNA- or DsiRNA-type molecule, are encompassed by "dsRNA" for the purposes of this specification and claims.

The phrase "duplex region" refers to the region in two complementary or substantially complementary oligonucleotides that form base pairs with one another, either by Watson-Crick base pairing or other manner that allows for a duplex between oligonucleotide strands that are complementary or substantially complementary. For example, an oligonucleotide strand having 21 nucleotide units can base pair with another oligonucleotide of 21 nucleotide units, yet only 19 bases on each strand are complementary or substantially complementary, such that the "duplex region" consists of 19 base pairs. The remaining base pairs may, for example, exist as 5' and 3' overhangs. Further, within the duplex region, 100% complementarity is not required; substantial complementarity is allowable within a duplex region. Substantial complementarity refers to complementarity between the strands such that they are capable of annealing under biological conditions. Techniques to empirically determine if two strands are capable of annealing under biological conditions are well know in the art. Alternatively, two strands can be synthesized and added together under biological conditions to determine if they anneal to one another.

Single-stranded nucleic acids that base pair over a number of bases are said to "hybridize." Hybridization is typically determined under physiological or biologically relevant conditions (e.g., intracellular: pH 7.2, 140 mM potassium ion; extracellular pH 7.4, 145 mM sodium ion). Hybridization conditions generally contain a monovalent cation and biologically acceptable buffer and may or may not contain a divalent cation, complex anions, e.g. gluconate from potassium gluconate, uncharged species such as sucrose, and inert polymers to reduce the activity of water in the sample, e.g. PEG. Such conditions include conditions under which base pairs can form.

Hybridization is measured by the temperature required to dissociate single stranded nucleic acids forming a duplex, i.e., (the melting temperature; Tm). Hybridization conditions are also conditions under which base pairs can form. Various conditions of stringency can be used to determine hybridization (see, e.g., Wahl, G. M. and S. L. Berger (1987) Methods Enzymol. 152:399; Kimmel, A. R. (1987) Methods Enzymol. 152:507). Stringent temperature conditions will ordinarily include temperatures of at least about 30° C., more preferably of at least about 37° C., and most preferably of at least about 42° C. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm (° C.)=2(# of A+T bases)+4(# of G+C bases). For hybrids between 18 and 49 base pairs in length, Tm (° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). For example, a hybridization determination buffer is shown in Table 1.

Useful variations on hybridization conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Antisense to Molecular Cloning Techniques, 1987, Academic Press, New York); and Sambrook et al., Molecular Cloning: A Laboratory Manual, Cold Spring Harbor Laboratory Press, New York.

As used herein, "oligonucleotide strand" is a single stranded nucleic acid molecule. An oligonucleotide may comprise ribonucleotides, deoxyribonucleotides, modified nucleotides (e.g., nucleotides with 2' modifications, synthetic base analogs, etc.) or combinations thereof. Such modified oligonucleotides can be preferred over native forms because of properties such as, for example, enhanced cellular uptake and increased stability in the presence of nucleases.

As used herein, the term "ribonucleotide" encompasses natural and synthetic, unmodified and modified ribonucleotides. Modifications include changes to the sugar moiety, to the base moiety and/or to the linkages between ribonucleotides in the oligonucleotide. As used herein, the term "ribonucleotide" specifically excludes a deoxyribonucleotide, which is a nucleotide possessing a single proton group at the 2' ribose ring position.

As used herein, the term "deoxyribonucleotide" encompasses natural and synthetic, unmodified and modified deoxyribonucleotides. Modifications include changes to the sugar moiety, to the base moiety and/or to the linkages between deoxyribonucleotide in the oligonucleotide. As used herein, the term "deoxyribonucleotide" also includes a modified ribonucleotide that does not permit Dicer cleavage of a dsRNA agent, e.g., a 2'-O-methyl ribonucleotide, a phosphorothioate-modified ribonucleotide residue, etc., that does not permit Dicer cleavage to occur at a bond of such a residue.

As used herein, the term "PS-NA" refers to a phosphorothioate-modified nucleotide residue. The term "PS-NA" therefore encompasses both phosphorothioate-modified ribonucleotides ("PS-RNAs") and phosphorothioate-modified deoxyribonucleotides ("PS-DNAs").

As used herein, "Dicer" refers to an endoribonuclease in the RNase III family that cleaves a dsRNA or dsRNA-containing molecule, e.g., double-stranded RNA (dsRNA) or pre-microRNA (miRNA), into double-stranded nucleic acid fragments 19-25 nucleotides long, usually with a two-base overhang on the 3' end. With respect to certain dsRNAs of the invention (e.g., "DsiRNAs"), the duplex formed by a dsRNA region of an agent of the invention is recognized by

TABLE 1

|  | final conc. | Vender | Cat# | Lot# | m.w./Stock | To make 50 mL solution |
| --- | --- | --- | --- | --- | --- | --- |
| NaCl | 100 mM | Sigma | S-5150 | 41K8934 | 5M | 1 mL |
| KCl | 80 mM | Sigma | P-9541 | 70K0002 | 74.55 | 0.298 g |
| MgCl$_2$ | 8 mM | Sigma | M-1028 | 120K8933 | 1M | 0.4 mL |
| sucrose | 2% w/v | Fisher | BP220-212 | 907105 | 342.3 | 1 g |
| Tris-HCl | 16 mM | Fisher | BP1757-500 | 12419 | 1M | 0.8 mL |
| NaH$_2$PO$_4$ | 1 mM | Sigma | S-3193 | 52H-029515 | 120.0 | 0.006 g |
| EDTA | 0.02 mM | Sigma | E-7889 | 110K89271 | 0.5M | 2 µL |
| H$_2$O |  | Sigma | W-4502 | 51K2359 |  | to 50 mL |
| pH = 7.0 |  |  |  | adjust with HCl |  |  |
| at 20° C. |  |  |  |  |  |  |

Dicer and is a Dicer substrate on at least one strand of the duplex. Dicer catalyzes the first step in the RNA interference pathway, which consequently results in the degradation of a target RNA. The protein sequence of human Dicer is provided at the NCBI database under accession number NP_085124, hereby incorporated by reference.

Dicer "cleavage" can be determined as follows (e.g., see Collingwood et al., Oligonucleotides 18:187-200 (2008)). In a Dicer cleavage assay, RNA duplexes (100 pmol) are incubated in 20 µL of 20 mM Tris pH 8.0, 200 mM NaCl, 2.5 mM MgCl2 with or without 1 unit of recombinant human Dicer (Stratagene, La Jolla, Calif.) at 37° C. for 18-24 hours. Samples are desalted using a Performa SR 96-well plate (Edge Biosystems, Gaithersburg, Md.). Electrospray-ionization liquid chromatography mass spectroscopy (ESI-LCMS) of duplex RNAs pre- and post-treatment with Dicer is done using an Oligo HTCS system (Novatia, Princeton, N.J.; Hail et al., 2004), which consists of a ThermoFinnigan TSQ7000, Xcalibur data system, ProMass data processing software and Paradigm MS4 HPLC (Michrom BioResources, Auburn, Calif.). In this assay, Dicer cleavage occurs where at least 5%, 10%, 20%, 30%, 40%, 50%, 60%, 70%, 80%, 90%, 95%, or even 100% of the Dicer substrate dsRNA, (i.e., 25-30 bp, dsRNA, preferably 26-30 bp dsRNA) is cleaved to a shorter dsRNA (e.g., 19-23 bp dsRNA, preferably, 21-23 bp dsRNA).

As used herein, "Dicer cleavage site" refers to the sites at which Dicer cleaves a dsRNA (e.g., the dsRNA region of a DsiRNA agent of the invention). Dicer contains two RNase III domains which typically cleave both the sense and antisense strands of a dsRNA. The average distance between the RNase III domains and the PAZ domain determines the length of the short double-stranded nucleic acid fragments it produces and this distance can vary (Macrae et al. (2006) Science 311: 195-8). As shown in FIG. 1, Dicer is projected to cleave certain double-stranded ribonucleic acids of the instant invention that possess an antisense strand having a 2 nucleotide 3' overhang at a site between the $21^{st}$ and $22^{nd}$ nucleotides removed from the 3' terminus of the antisense strand, and at a corresponding site between the $21^{st}$ and $22^{nd}$ nucleotides removed from the 5' terminus of the sense strand. The projected and/or prevalent Dicer cleavage site(s) for dsRNA molecules distinct from those depicted in FIG. 1 may be similarly identified via art-recognized methods, including those described in Macrae et al. While the Dicer cleavage events depicted in FIG. 1 generate 21 nucleotide siRNAs, it is noted that Dicer cleavage of a dsRNA (e.g., DsiRNA) can result in generation of Dicer-processed siRNA lengths of 19 to 23 nucleotides in length. Indeed, in certain embodiments, a double-stranded DNA region may be included within a dsRNA for purpose of directing prevalent Dicer excision of a typically non-preferred 19 mer or 20 mer siRNA, rather than a 21 mer.

As used herein, "overhang" refers to unpaired nucleotides, in the context of a duplex having one or more free ends at the 5' terminus or 3' terminus of a dsRNA. In certain embodiments, the overhang is a 3' or 5' overhang on the antisense strand or sense strand. In some embodiments, the overhang is a 3' overhang having a length of between one and six nucleotides, optionally one to five, one to four, one to three, one to two, two to six, two to five, two to four, two to three, three to six, three to five, three to four, four to six, four to five, five to six nucleotides, or one, two, three, four, five or six nucleotides. "Blunt" or "blunt end" means that there are no unpaired nucleotides at that end of the dsRNA, i.e., no nucleotide overhang. For clarity, chemical caps or non-nucleotide chemical moieties conjugated to the 3' end or 5' end of an siRNA are not considered in determining whether an siRNA has an overhang or is blunt ended. In certain embodiments, the invention provides a dsRNA molecule for inhibiting the expression of the transthyretin target gene in a cell or mammal, wherein the dsRNA comprises an antisense strand comprising a region of complementarity which is complementary to at least a part of an mRNA formed in the expression of the transthyretin target gene, and wherein the region of complementarity is less than 35 nucleotides in length, optionally 19-24 nucleotides in length or 25-30 nucleotides in length, and wherein the dsRNA, upon contact with a cell expressing the transthyretin target gene, inhibits the expression of the transthyretin target gene by at least 10%, 25%, or 40%.

A dsRNA of the invention comprises two RNA strands that are sufficiently complementary to hybridize to form a duplex structure. One strand of the dsRNA (the antisense strand) comprises a region of complementarity that is substantially complementary, and generally fully complementary, to a target sequence, derived from the sequence of an mRNA formed during the expression of the transthyretin target gene, the other strand (the sense strand) comprises a region which is complementary to the antisense strand, such that the two strands hybridize and form a duplex structure when combined under suitable conditions. Generally, the duplex structure is between 15 and 35, optionally between 25 and 30, between 26 and 30, between 18 and 25, between 19 and 24, or between 19 and 21 base pairs in length. Similarly, the region of complementarity to the target sequence is between 15 and 35, optionally between 18 and 30, between 25 and 30, between 19 and 24, or between 19 and 21 nucleotides in length. The dsRNA of the invention may further comprise one or more single-stranded nucleotide overhang(s). It has been identified that dsRNAs comprising duplex structures of between 15 and 35 base pairs in length can be effective in inducing RNA interference, including DsiRNAs (generally of at least 25 base pairs in length) and siRNAs (in certain embodiments, duplex structures of siRNAs are between 20 and 23, and optionally, specifically 21 base pairs (Elbashir et al., EMBO 20: 6877-6888)). It has also been identified that dsRNAs possessing duplexes shorter than 20 base pairs can be effective as well (e.g., 15, 16, 17, 18 or 19 base pair duplexes). In certain embodiments, the dsRNAs of the invention can comprise at least one strand of a length of 19 nucleotides or more. In certain embodiments, it can be reasonably expected that shorter dsRNAs comprising a sequence complementary to one of the sequences of Table 4, minus only a few nucleotides on one or both ends may be similarly effective as compared to the dsRNAs described above and in Tables 2-3 and 5. Hence, dsRNAs comprising a partial sequence of at least 15, 16, 17, 18, 19, 20, or more contiguous nucleotides sufficiently complementary to one of the sequences of Table 4, and differing in their ability to inhibit the expression of the transthyretin target gene in an assay as described herein by not more than 5, 10, 15, 20, 25, or 30% inhibition from a dsRNA comprising the full sequence, are contemplated by the invention. In one embodiment, at least one end of the dsRNA has a single-stranded nucleotide overhang of 1 to 5, optionally 1 to 4, in certain embodiments, 1 or 2 nucleotides. Certain dsRNA structures having at least one nucleotide overhang possess superior inhibitory properties as compared to counterparts possessing base-paired blunt ends at both ends of the dsRNA molecule.

As used herein, the term "RNA processing" refers to processing activities performed by components of the siRNA, miRNA or RNase H pathways (e.g., Drosha, Dicer, Argonaute2 or other RISC endoribonucleases, and RNaseH), which are described in greater detail below (see "RNA Processing" section below). The term is explicitly distinguished from the post-transcriptional processes of 5' capping of RNA and degradation of RNA via non-RISC- or non-RNase H-mediated processes. Such "degradation" of an RNA can take several forms, e.g. deadenylation (removal of a 3' poly(A) tail), and/or nuclease digestion of part or all of the body of the RNA by one or more of several endo- or exo-nucleases (e.g., RNase III, RNase P, RNase T1, RNase A (1, 2, 3, 4/5), oligonucleotidase, etc.).

By "homologous sequence" is meant a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes, such as a cytokine and its corresponding receptors. A homologous sequence can be a nucleotide sequence that is shared by two or more non-coding polynucleotides, such as noncoding DNA or RNA, regulatory sequences, introns, and sites of transcriptional control or regulation. Homologous sequences can also include conserved sequence regions shared by more than one polynucleotide sequence. Homology does not need to be perfect homology (e.g., 100%), as partially homologous sequences are also contemplated by the instant invention (e.g., 99%, 98%, 97%, 96%, 95%, 94%, 93%, 92%, 91%, 90%, 89%, 88%, 87%, 86%, 85%, 84%, 83%, 82%, 81%, 80% etc.). Indeed, design and use of the dsRNA agents of the instant invention contemplates the possibility of using such dsRNA agents not only against target RNAs of transthyretin possessing perfect complementarity with the presently described dsRNA agents, but also against target transthyretin RNAs possessing sequences that are, e.g., only 99%, 98%, 97%, 96%, 95%, 94%, 93%, 92%, 91%, 90%, 89%, 88%, 87%, 86%, 85%, 84%, 83%, 82%, 81%, 80% etc. complementary to said dsRNA agents. Similarly, it is contemplated that the presently described dsRNA agents of the instant invention might be readily altered by the skilled artisan to enhance the extent of complementarity between said dsRNA agents and a target transthyretin RNA, e.g., of a specific allelic variant of transthyretin (e.g., an allele of enhanced therapeutic interest). Indeed, dsRNA agent sequences with insertions, deletions, and single point mutations relative to the target transthyretin sequence can also be effective for inhibition. Alternatively, dsRNA agent sequences with nucleotide analog substitutions or insertions can be effective for inhibition.

Sequence identity may be determined by sequence comparison and alignment algorithms known in the art. To determine the percent identity of two nucleic acid sequences (or of two amino acid sequences), the sequences are aligned for comparison purposes (e.g., gaps can be introduced in the first sequence or second sequence for optimal alignment). The nucleotides (or amino acid residues) at corresponding nucleotide (or amino acid) positions are then compared. When a position in the first sequence is occupied by the same residue as the corresponding position in the second sequence, then the molecules are identical at that position. The percent identity between the two sequences is a function of the number of identical positions shared by the sequences (i.e., % homology=# of identical positions/total # of positions×100), optionally penalizing the score for the number of gaps introduced and/or length of gaps introduced.

The comparison of sequences and determination of percent identity between two sequences can be accomplished using a mathematical algorithm. In one embodiment, the alignment generated over a certain portion of the sequence aligned having sufficient identity but not over portions having low degree of identity (i.e., a local alignment). A preferred, non-limiting example of a local alignment algorithm utilized for the comparison of sequences is the algorithm of Karlin and Altschul (1990) *Proc. Natl. Acad. Sci. USA* 87:2264-68, modified as in Karlin and Altschul (1993) *Proc. Natl. Acad. Sci. USA* 90:5873-77. Such an algorithm is incorporated into the BLAST programs (version 2.0) of Altschul, et al. (1990) *J. Mol. Biol.* 215:403-10.

In another embodiment, a gapped alignment, the alignment is optimized by introducing appropriate gaps, and percent identity is determined over the length of the aligned sequences (i.e., a gapped alignment). To obtain gapped alignments for comparison purposes, Gapped BLAST can be utilized as described in Altschul et al., (1997) Nucleic Acids Res. 25(17):3389-3402. In another embodiment, a global alignment the alignment is optimized by introducing appropriate gaps, and percent identity is determined over the entire length of the sequences aligned. (i.e., a global alignment). A preferred, non-limiting example of a mathematical algorithm utilized for the global comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM 120 weight residue table, a gap length penalty of 12, and a gap penalty of 4 can be used.

Greater than 80% sequence identity, e.g., 80%, 81%, 82%, 83%, 84%, 85%, 86%, 87%, 88%, 89%, 90%, 91%, 92%, 93%, 94%, 95%, 96%, 97%, 98%, 99% or even 100% sequence identity, between the dsRNA antisense strand and the portion of the transthyretin RNA sequence is preferred. Alternatively, the dsRNA may be defined functionally as a nucleotide sequence (or oligonucleotide sequence) that is capable of hybridizing with a portion of the transthyretin RNA (e.g., 400 mM NaCl, 40 mM PIPES pH 6.4, 1 mM EDTA, 50° C. or 70° C. hybridization for 12-16 hours; followed by washing). Additional preferred hybridization conditions include hybridization at 70° C. in 1×SSC or 50° C. in 1×SSC, 50% formamide followed by washing at 70° C. in 0.3×SSC or hybridization at 70° C. in 4×SSC or 50° C. in 4×SSC, 50% formamide followed by washing at 67° C. in 1×SSC. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm (° C.)=2(# of A+T bases)+4(# of G+C bases). For hybrids between 18 and 49 base pairs in length, Tm (° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). Additional examples of stringency conditions for polynucleotide hybridization are provided in Sambrook, J., E. F. Fritsch, and T. Maniatis, 1989, Molecular Cloning: A Laboratory Manual, Cold Spring Harbor Laboratory Press, Cold Spring Harbor, N.Y., chapters 9 and 11, and Current Protocols in Molecular Biology, 1995, F. M. Ausubel et al., eds., John Wiley & Sons, Inc., sections 2.10 and 6.3-6.4. The length of the identical nucleotide sequences may be at least 10, 12, 15, 17, 20, 22, 25, 27 or 30 bases.

By "conserved sequence region" is meant, a nucleotide sequence of one or more regions in a polynucleotide does not vary significantly between generations or from one biological system, subject, or organism to another biological system, subject, or organism. The polynucleotide can include both coding and non-coding DNA and RNA.

By "sense region" is meant a nucleotide sequence of a dsRNA molecule having complementarity to an antisense region of the dsRNA molecule. In addition, the sense region of a dsRNA molecule can comprise a nucleic acid sequence having homology with a target nucleic acid sequence.

By "antisense region" is meant a nucleotide sequence of a dsRNA molecule having complementarity to a target nucleic acid sequence. In addition, the antisense region of a dsRNA molecule comprises a nucleic acid sequence having complementarity to a sense region of the dsRNA molecule.

As used herein, "antisense strand" refers to a single stranded nucleic acid molecule which has a sequence complementary to that of a target RNA. When the antisense strand contains modified nucleotides with base analogs, it is not necessarily complementary over its entire length, but must at least hybridize with a target RNA.

As used herein, "sense strand" refers to a single stranded nucleic acid molecule which has a sequence complementary to that of an antisense strand. When the antisense strand contains modified nucleotides with base analogs, the sense strand need not be complementary over the entire length of the antisense strand, but must at least duplex with the antisense strand.

As used herein, "guide strand" refers to a single stranded nucleic acid molecule of a dsRNA or dsRNA-containing molecule, which has a sequence sufficiently complementary to that of a target RNA to result in RNA interference. After cleavage of the dsRNA or dsRNA-containing molecule by Dicer, a fragment of the guide strand remains associated with RISC, binds a target RNA as a component of the RISC complex, and promotes cleavage of a target RNA by RISC. As used herein, the guide strand does not necessarily refer to a continuous single stranded nucleic acid and may comprise a discontinuity, preferably at a site that is cleaved by Dicer. A guide strand is an antisense strand.

As used herein, "passenger strand" refers to an oligonucleotide strand of a dsRNA or dsRNA-containing molecule, which has a sequence that is complementary to that of the guide strand. As used herein, the passenger strand does not necessarily refer to a continuous single stranded nucleic acid and may comprise a discontinuity, preferably at a site that is cleaved by Dicer. A passenger strand is a sense strand.

By "target nucleic acid" is meant a nucleic acid sequence whose expression, level or activity is to be modulated. The target nucleic acid can be DNA or RNA. For agents that target transthyretin, in certain embodiments, the target nucleic acid is transthyretin RNA, e.g., in certain embodiments, transthyretin mRNA. Transthyretin RNA target sites can also interchangeably be referenced by corresponding cDNA sequences. Levels of transthyretin may also be targeted via targeting of upstream effectors of transthyretin, or the effects of modulated or misregulated transthyretin may also be modulated by targeting of molecules downstream of transthyretin in the transthyretin signalling pathway.

By "complementarity" is meant that a nucleic acid can form hydrogen bond(s) with another nucleic acid sequence by either traditional Watson-Crick or other non-traditional types. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, CSH Symp. Quant. Biol. LII pp. 123-133; Frier et al., 1986, Proc. Nat. Acad. Sci. USA 83:9373-9377; Turner et al., 1987, J. Am. Chem. Soc. 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). "Perfectly complementary" means that all the contiguous residues of a nucleic acid sequence will hydrogen bond with the same number of contiguous residues in a second nucleic acid sequence. In one embodiment, a dsRNA molecule of the invention comprises 19 to 30 (e.g., 19, 20, 21, 22, 23, 24, 25, 26, 27, 28, 29, or 30 or more) nucleotides that are complementary to one or more target nucleic acid molecules or a portion thereof.

As used herein, a dsNA, e.g., DsiRNA or siRNA, having a sequence "sufficiently complementary" to a target RNA or cDNA sequence (e.g., transthyretin mRNA) means that the dsNA has a sequence sufficient to trigger the destruction of the target RNA (where a cDNA sequence is recited, the RNA sequence corresponding to the recited cDNA sequence) by the RNAi machinery (e.g., the RISC complex) or process. For example, a dsNA that is "sufficiently complementary" to a target RNA or cDNA sequence to trigger the destruction of the target RNA by the RNAi machinery or process can be identified as a dsNA that causes a detectable reduction in the level of the target RNA in an appropriate assay of dsNA activity (e.g., an in vitro assay as described in Example 2 below), or, in further examples, a dsNA that is sufficiently complementary to a target RNA or cDNA sequence to trigger the destruction of the target RNA by the RNAi machinery or process can be identified as a dsNA that produces at least a 5%, at least a 10%, at least a 15%, at least a 20%, at least a 25%, at least a 30%, at least a 35%, at least a 40%, at least a 45%, at least a 50%, at least a 55%, at least a 60%, at least a 65%, at least a 70%, at least a 75%, at least a 80%, at least a 85%, at least a 90%, at least a 95%, at least a 98% or at least a 99% reduction in the level of the target RNA in an appropriate assay of dsNA activity. In additional examples, a dsNA that is sufficiently complementary to a target RNA or cDNA sequence to trigger the destruction of the target RNA by the RNAi machinery or process can be identified based upon assessment of the duration of a certain level of inhibitory activity with respect to the target RNA or protein levels in a cell or organism. For example, a dsNA that is sufficiently complementary to a target RNA or cDNA sequence to trigger the destruction of the target RNA by the RNAi machinery or process can be identified as a dsNA capable of reducing target mRNA levels by at least 20% at least 48 hours post-administration of said dsNA to a cell or organism. Preferably, a dsNA that is sufficiently complementary to a target RNA or cDNA sequence to trigger the destruction of the target RNA by the RNAi machinery or process is identified as a dsNA capable of reducing target mRNA levels by at least 40% at least 72 hours post-administration of said dsNA to a cell or organism, by at least 40% at least four, five or seven days post-administration of said dsNA to a cell or organism, by at least 50% at least 48 hours post-administration of said dsNA to a cell or organism, by at least 50% at least 72 hours post-administration of said dsNA to a cell or organism, by at least 50% at least four, five or seven days post-administration of said dsNA to a cell or organism, by at least 80% at least 48 hours post-administration of said dsNA to a cell or organism, by at least 80% at least 72 hours post-administration of said dsNA to a cell or organism, or by at least 80% at least four, five or seven days post-administration of said dsNA to a cell or organism.

In certain embodiments, a nucleic acid of the invention (e.g., a DsiRNA or siRNA) possesses a sequence "sufficiently complementary to hybridize" to a target RNA or cDNA sequence, thereby achieving an inhibitory effect upon the target RNA. Hybridization, and conditions available for determining whether one nucleic acid is sufficiently complementary to another nucleic acid to allow the two sequences to hybridize, is described in greater detail below.

As will be clear to one of ordinary skill in the art, "sufficiently complementary" (contrasted with, e.g., "100% complementary") allows for one or more mismatches to exist between a dsNA of the invention and the target RNA or cDNA sequence (e.g., transthyretin mRNA), provided that the dsNA possesses complementarity sufficient to trigger the destruction of the target RNA by the RNAi machinery (e.g., the RISC complex) or process. In certain embodiments, a "sufficiently complementary" dsNA of the invention can harbor one, two, three or even four or more mismatches between the dsNA sequence and the target RNA or cDNA sequence (e.g., in certain such embodiments, the antisense strand of the dsRNA harbors one, two, three, four, five or even six or more mismatches when aligned with the target RNA or cDNA sequence for maximum complementarity). Additional consideration of the preferred location of such mismatches within certain dsRNAs of the instant invention is considered in greater detail below.

In one embodiment, dsRNA molecules of the invention that down regulate or reduce transthyretin gene expression are used for treating, preventing or reducing transthyretin-related diseases or disorders (e.g., cancer) in a subject or organism.

In one embodiment of the present invention, each sequence of a DsiRNA molecule of the invention is independently 25 to 35 nucleotides in length, in specific embodiments 25, 26, 27, 28, 29, 30, 31, 32, 33, 34 or 35 nucleotides in length. In another embodiment, the DsiRNA duplexes of the invention independently comprise 25 to 30 base pairs (e.g., 25, 26, 27, 28, 29, or 30). In another embodiment, one or more strands of the DsiRNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (transthyretin) nucleic acid molecule. In certain embodiments, a DsiRNA molecule of the invention possesses a length of duplexed nucleotides between 25 and 66 nucleotides, optionally between 25 and 49 nucleotides in length (e.g., 25, 26, 27, 28, 29, 30, 31, 32, 33, 34, 35, 36, 37, 38, 39, 40, 41, 42, 43, 44, 45, 46, 47, 48 or 49, 50, 51, 52, 53, 54, 55, 56, 57, 58, 59, 60, 61, 62, 63, 64, 65, 66 nucleotides in length; optionally, all such nucleotides base pair with cognate nucleotides of the opposite strand). In related embodiments, a dsNA of the invention possesses strand lengths that are, independently, between 19 and 66 nucleotides in length, optionally between 25 and 53 nucleotides in length, e.g., 19, 20, 21, 22, 23, 24, 25, 26, 27, 28, 29, 30, 31, 32, 33, 34, 35, 36, 37, 38, 39, 40, 41, 42, 43, 44, 45, 46, 47, 48 or 49, 50, 51, 52, 53, 54, 55, 56, 57, 58, 59, 60, 61, 62, 63, 64, 65, 66 nucleotides in length. In certain embodiments, one strand length is 19-35 nucleotides in length, while the other strand length is 30-66 nucleotides in length and at least one strand has a 5' overhang of at least 5 nucleotides in length relative to the other strand. In certain related embodiments, the 3' end of the first strand and the 5' end of the second strand form a structure that is a blunt end or a 1-6 nucleotide 3' overhang, while the 5' end of the first strand forms a 5-35 nucleotide overhang with respect to the 3' end of the second strand. Optionally, between one and all nucleotides of the 5-35 nucleotide overhang are modified nucleotides (optionally, deoxyribonucleotides and/or modified ribonucleotides).

In some embodiments, a dsNA of the invention has a first or second strand that has at least 8 contiguous ribonucleotides. In certain embodiments, a dsNA of the invention has 9, 10, 11, 12, 13, 14, 15, 16, 17, 18, 19, 20, 21, 22, 23 or more (e.g., 24, 25, 26, 27, 28, 29, 30, 31, 32, 33, 34, 35, 26, or more, up to the full length of the strand) ribonucleotides, optionally including modified ribonucleotides (2'-O-methyl ribonucleotides, phosphorothioate linkages, etc.). In certain embodiments, the ribonucleotides or modified ribonucleotides are contiguous.

In certain embodiments of the invention, tetraloop- and modified nucleotide-containing dsNAs are contemplated as described, e.g., in US 2011/0288147. In certain such embodiments, a dsNA of the invention possesses a first strand and a second strand, where the first strand and the second strand form a duplex region of 19-25 nucleotides in length, wherein the first strand comprises a 3' region that extends beyond the first strand-second strand duplex region and comprises a tetraloop, and the dsNA comprises a discontinuity between the 3' terminus of the first strand and the 5' terminus of the second strand. Optionally, the discontinuity is positioned at a projected dicer cleavage site of the tetraloop-containing dsNA.

In certain embodiments, a dsNA comprising a first strand and a second strand, each strand, independently, having a 5' terminus and a 3' terminus, and having, independently, respective strand lengths of 25-53 nucleotides in length, is sufficiently highly modified (e.g., at least 10% or more, at least 20% or more, at least 30% or more, at least 40% or more, at least 50% or more, at least 60% or more, at least 70% or more, at least 80% or more, at least 90% or more, at least 95% or more residues of one and/or both strands are modified such that dicer cleavage of the dsNA is prevented (optionally, modified residues occur at and/or flanking one or all predicted dicer cleavage sites of the dsNA). Such non-dicer-cleaved dsNAs retain LDH inhibition activity and are optionally cleaved by non-dicer nucleases to yield, e.g., 15-30, or in particular embodiments, 19-23 nucleotide strand length dsNAs capable of inhibiting LDH in a mammalian cell. In certain related embodiments, dsNAs possessing sufficiently extensive modification to block dicer cleavage of such dsNAs optionally possess regions of unmodified nucleotide residues (e.g., one or two or more consecutive nucleotides, forming a "gap" or "window" in a modification pattern) that allow for and/or promote cleavage of such dsNAs by non-Dicer nucleases. In other embodiments, Dicer-cleaved dsNAs of the invention can include extensive modification patterns that possess such "windows" or "gaps" in modification such that Dicer cleavage preferentially occurs at such sites (as compared to heavily modified regions within such dsNAs).

In certain additional embodiments of the present invention, each oligonucleotide of a DsiRNA molecule of the invention is independently 25 to 53 nucleotides in length, in specific embodiments 25, 26, 27, 28, 29, 30, 31, 32, 33, 34, 35, 36, 37, 38, 39, 40, 41, 42, 43, 44, 45, 46, 47, 48, 49, 50, 51, 52 or 53 nucleotides in length. For DsiRNAs possessing a strand that exceeds 30 nucleotides in length, available structures include those where only one strand exceeds 30 nucleotides in length (see, e.g., U.S. Pat. No. 8,349,809), or those where both strands exceed 30 nucleotides in length (see, e.g., WO 2010/080129). Stabilizing modifications (e.g., 2'-O-Methyl, phosphorothioate, deoxyribonucleotides, including dNTP base pairs, 2'-F, etc.) can be incorporated within any double stranded nucleic acid of the invention, and can be used in particular, and optionally in abundance, especially within DsiRNAs possessing one or both strands exceeding 30 nucleotides in length. While the guide strand of a double stranded nucleic acid of the invention must possess a sequence of, e.g., 15, 16, 17, 18 or 19 nucleotides that are complementary to a target RNA (e.g., mRNA), additional sequence(s) of the guide strand need not be complementary to the target RNA. The end structures of double stranded nucleic acids possessing at least one strand length in excess of 30 nucleotides can also be varied while continuing to yield functional dsNAs—e.g. the 5' end of the guide strand and the 3' end of the passenger strand may form a 5'-overhang, a blunt end or a 3' overhang (for certain dsNAs, e.g., "single strand extended" dsNAs, the length of such a 5' or 3' overhang can be 1-4, 1-5, 1-6, 1-10, 1-15, 1-20 or even 1-25 or more); similarly, the 3' end of the guide strand and the 5' end of the passenger strand may form a 5'-overhang, a blunt end or a 3' overhang (for certain dsNAs, e.g., "single strand extended" dsNAs, the length of such a 5' or 3' overhang can be 1-4, 1-5, 1-6, 1-10, 1-15, 1-20 or even 1-25 or more). Optionally, such single strand extensions of the dsNAs of the invention can be modified, e.g., with phosphorothioate (PS), 2'-F, 2'-O-methyl and/or other forms of modification contemplated herein or known in the art, including conjugation to, e.g., GalNAc moieties. In certain embodiments, the length of the passenger strand is 31-49 nucleotides while the length of the guide strand is 31-53 nucleotides, optionally while the 5' end of the guide strand forms a blunt end (optionally, a base-paired blunt end) with the 3' end of the passenger strand, optionally, with the 3' end of the guide strand and the 5' end of the passenger strand forming a 3' overhang of 1-4 nucleotides in length. Exemplary "extended" Dicer substrate structures are set forth, e.g., in U.S. Pat. No. 8,513,207 and U.S. Pat. No. 8,349,809, both of which are incorporated herein by reference. In certain embodiments, one or more strands of the dsNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (transthyretin) nucleic acid molecule. In certain embodiments, a DsiRNA molecule of the invention possesses a length of duplexed nucleotides between 25 and 49 nucleotides in length (e.g., 25, 26, 27, 28, 29, 30, 31, 32, 33, 34, 35, 36, 37, 38, 39, 40, 41, 42, 43, 44, 45, 46, 47, 48 or 49 nucleotides in length; optionally, all such nucleotides base pair with cognate nucleotides of the opposite strand).

In a further embodiment of the present invention, each oligonucleotide of a DsiRNA molecule of the invention is independently 19 to 66 nucleotides in length, in specific embodiments 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65 or 66 nucleotides in length. For dsNAs possessing a strand that exceeds 30 nucleotides in length, available structures include those where only one strand exceeds 30 nucleotides in length (see, e.g., U.S. Pat. No. 8,349,809, where an exemplary double stranded nucleic acid possesses a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first strand (or the second strand) is 25-30 nucleotide residues in length, where starting from the 5' terminal nucleotide (position 1) positions 1 to 23 of the first strand (or the second strand) include at least 8 ribonucleotides; the second strand (or the first strand) is 36-66 nucleotide residues in length and, starting from the 3' terminal nucleotide, includes at least 8 ribonucleotides in the positions paired with positions 1-23 of the first strand to form a duplex; where at least the 3' terminal nucleotide of the second strand (or the first strand) is unpaired with the first strand (or the second strand), and up to 6 consecutive 3' terminal nucleotides are unpaired with the first strand (or the second strand), thereby forming a 3' single stranded overhang of 1-6 nucleotides; where the 5' terminus of the second strand (or the first strand) includes from 10-30 consecutive nucleotides which are unpaired with the first strand (or the second strand), thereby forming a 10-30 nucleotide single stranded 5' overhang; where at least the first strand (or the second strand) 5' terminal and 3' terminal nucleotides are base paired with nucleotides of the second strand (or first strand) when the first and second strands are aligned for maximum complementarity, thereby forming a substantially duplexed region between the first and second strands; and the second strand is sufficiently complementary to a target RNA along at least 19 ribonucleotides of the second strand length to reduce target gene expression when the double stranded nucleic acid is introduced into a mammalian cell), or those where both strands exceed 30 nucleotides in length (see, e.g., U.S. Pat. No. 8,513,207, where an exemplary double stranded nucleic acid (dsNA) possesses a first oligonucleotide strand having a 5' terminus and a 3' terminus and a second oligonucleotide strand having a 5' terminus and a 3' terminus, where the first strand is 31 to 49 nucleotide residues in length, where starting from the first nucleotide (position 1) at the 5' terminus of the first strand, positions 1 to 23 of the first strand are ribonucleotides; the second strand is 31 to 53 nucleotide residues in length and includes 23 consecutive ribonucleotides that base pair with the ribonucleotides of positions 1 to 23 of the first strand to form a duplex; the 5' terminus of the first strand and the 3' terminus of said second strand form a blunt end or a 1-4 nucleotide 3' overhang; the 3' terminus of the first strand and the 5' terminus of said second strand form a duplexed blunt end, a 5' overhang or a 3' overhang; optionally, at least one of positions 24 to the 3' terminal nucleotide residue of the first strand is a deoxyribonucleotide, optionally, that base pairs with a deoxyribonucleotide of said second strand; and the second strand is sufficiently complementary to a target RNA along at least 19 ribonucleotides of the second strand length to reduce target gene expression when the double stranded nucleic acid is introduced into a mammalian cell).

In certain embodiments, an active dsNA of the invention can possess a 5' overhang of the first strand (optionally, the passenger strand) with respect to the second strand (optionally, the guide strand) of 2-50 nucleotides (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50) or more in length. In related embodiments, the duplex region formed by the first and second strands of such a dsNA is 15, 16, 17, 18, 19, 20, 21, 22, 23, 24, 25 or more base pairs in length. The 5' overhang "extended" region of the first strand is optionally modified at one or more residues (optionally, at alternating residues, all residues, or any other selection of residues).

In certain embodiments, an active dsNA of the invention can possess a 3' overhang of the first strand (optionally, the passenger strand) with respect to the second strand (optionally, the guide strand) of 2-50 nucleotides (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50) or more in length. In related embodiments, the duplex region formed by the first and second strands of such a dsNA is 15, 16, 17, 18, 19, 20, 21, 22, 23, 24, 25 or more base pairs in length. The 3' overhang "extended" region of the first strand is optionally modified at one or more residues (optionally, at alternating residues, all residues, or any other selection of residues).

In additional embodiments, an active dsNA of the invention can possess a 5' overhang of the second strand (optionally, the guide strand) with respect to the first strand (optionally, the passenger strand) of 2-50 nucleotides (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50) or more in length. In related embodiments, the duplex region formed by the first and second strands of such a dsNA is 15, 16, 17, 18, 19, 20, 21, 22, 23, 24, 25 or more base pairs in length. The 5' overhang "extended" region of the second strand is optionally modified at one or more residues (optionally, at alternating residues, all residues, or any other selection of residues).

In further embodiments, an active dsNA of the invention can possess a 3' overhang of the second strand (optionally, the guide strand) with respect to the first strand (optionally, the passenger strand) of 2-50 nucleotides (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50) or more in length. In related embodiments, the duplex region formed by the first and second strands of such a dsNA is 15, 16, 17, 18, 19, 20, 21, 22, 23, 24, 25 or more base pairs in length. The 3' overhang "extended" region of the second strand is optionally modified at one or more residues (optionally, at alternating residues, all residues, or any other selection of residues).

In another embodiment of the present invention, each sequence of a DsiRNA molecule of the invention is independently 25 to 35 nucleotides in length, in specific embodiments 25, 26, 27, 28, 29, 30, 31, 32, 33, 34 or 35 nucleotides in length. In another embodiment, the DsiRNA duplexes of the invention independently comprise 25 to 30 base pairs (e.g., 25, 26, 27, 28, 29, or 30). In another embodiment, one or more strands of the DsiRNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (TTR) nucleic acid molecule. In certain embodiments, a DsiRNA molecule of the invention possesses a length of duplexed nucleotides between 25 and 34 nucleotides in length (e.g., 25, 26, 27, 28, 29, 30, 31, 32, 33 or 34 nucleotides in length; optionally, all such nucleotides base pair with cognate nucleotides of the opposite strand). (Exemplary DsiRNA molecules of the invention are shown in FIG. 1, and below.)

In certain embodiments, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more of the nucleotide residues of a nucleic acid of the instant invention are modified residues. For a dsNA of the invention, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more of the nucleotide residues of the first strand are modified residues. Additionally and/or alternatively for a dsNA of the invention, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more of the nucleotide residues of the second strand are modified residues. For the dsNAs of the invention, modifications of both duplex (double-stranded) regions and overhang (single-stranded) regions are contemplated. Thus, in certain embodiments, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more (e.g., all) duplex nucleotide residues are modified residues. Additionally and/or alternatively, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more (e.g., all) overhang nucleotide residues of one or both strands are modified residues. Optionally, the modifications of the dsNAs of the invention do not include an inverted abasic (e.g., inverted deoxy abasic) or inverted dT end-protecting group. Alternatively, a dsNA of the invention includes a terminal cap moiety (e.g., an inverted deoxy abasic and/or inverted dT end-protecting group). Optionally, such a terminal cap moiety is located at the 5' end, at the 3' end, or at both the 5' end and the 3' end of the first strand, of the second strand, or of both first and second strands.

As used herein "cell" is used in its usual biological sense, and does not refer to an entire multicellular organism, e.g., specifically does not refer to a human. The cell can be present in an organism, e.g., birds, plants and mammals such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell. Within certain aspects, the term "cell" refers specifically to mammalian cells, such as human cells, that contain one or more isolated dsRNA molecules of the present disclosure. In particular aspects, a cell processes dsRNAs or dsRNA-containing molecules resulting in RNA intereference of target nucleic acids, and contains proteins and protein complexes required for RNAi, e.g., Dicer and RISC.

In certain embodiments, dsRNAs of the invention are Dicer substrate siRNAs ("DsiRNAs"). DsiRNAs can possess certain advantages as compared to inhibitory nucleic acids that are not dicer substrates ("non-DsiRNAs"). Such advantages include, but are not limited to, enhanced duration of effect of a DsiRNA relative to a non-DsiRNA, as well as enhanced inhibitory activity of a DsiRNA as compared to a non-DsiRNA (e.g., a 19-23 mer siRNA) when each inhibitory nucleic acid is suitably formulated and assessed for inhibitory activity in a mammalian cell at the same concentration (in this latter scenario, the DsiRNA would be identified as more potent than the non-DsiRNA). Detection of the enhanced potency of a DsiRNA relative to a non-DsiRNA is often most readily achieved at a formulated concentration (e.g., transfection concentration of the dsRNA) that results in the DsiRNA eliciting approximately 30-70% knockdown activity upon a target RNA (e.g., a mRNA). For active DsiRNAs, such levels of knockdown activity are most often achieved at in vitro mammalian cell DsiRNA transfection concentrations of 1 nM or less of as suitably formulated, and in certain instances are observed at DsiRNA transfection concentrations of 200 pM or less, 100 pM or less, 50 pM or less, 20 pM or less, 10 pM or less, 5 pM or less, or even 1 pM or less. Indeed, due to the variability among DsiRNAs of the precise concentration at which 30-70% knockdown of a target RNA is observed, construction of an $IC_{50}$ curve via assessment of the inhibitory activity of DsiRNAs and non-DsiRNAs across a range of effective concentrations is a preferred method for detecting the enhanced potency of a DsiRNA relative to a non-DsiRNA inhibitory agent.

In certain embodiments, a DsiRNA (in a state as initially formed, prior to dicer cleavage) is more potent at reducing transthyretin target gene expression in a mammalian cell than a 19, 20, 21, 22 or 23 base pair sequence that is contained within it. In certain such embodiments, a DsiRNA prior to dicer cleavage is more potent than a 19-21 mer contained within it. Optionally, a DsiRNA prior to dicer cleavage is more potent than a 19 base pair duplex contained within it that is synthesized with symmetric dTdT overhangs (thereby forming a siRNA possessing 21 nucleotide strand lengths having dTdT overhangs). In certain embodiments, the DsiRNA is more potent than a 19-23 mer siRNA (e.g., a 19 base pair duplex with dTdT overhangs) that targets at least 19 nucleotides of the 21 nucleotide target sequence that is recited for a DsiRNA of the invention (without wishing to be bound by theory, the identity of a such a target site for a DsiRNA is identified via identification of the Ago2 cleavage site for the DsiRNA; once the Ago2 cleavage site of a DsiRNA is determined for a DsiRNA, identification of the Ago2 cleavage site for any other inhibitory dsRNA can be performed and these Ago2 cleavage sites can be aligned, thereby determining the alignment of projected target nucleotide sequences for multiple dsRNAs). In certain related embodiments, the DsiRNA is more potent than a 19-23 mer siRNA that targets at least 20 nucleotides of the 21 nucleotide target sequence that is recited for a DsiRNA of the invention. Optionally, the DsiRNA is more potent than a 19-23 mer siRNA that targets the same 21 nucleotide target sequence that is recited for a DsiRNA of the invention. In certain embodiments, the DsiRNA is more potent than any 21 mer siRNA that targets the same 21 nucleotide target sequence that is recited for a DsiRNA of the invention. Optionally, the DsiRNA is more potent than any 21 or 22 mer siRNA that targets the same 21 nucleotide target sequence that is recited for a DsiRNA of the invention. In certain embodiments, the DsiRNA is more potent than any 21, 22 or 23 mer siRNA that targets the same 21 nucleotide target sequence that is recited for a DsiRNA of the invention. As noted above, such potency assessments are most effectively performed upon dsRNAs that are suitably formulated (e.g., formulated with an appropriate transfection reagent) at a concentration of 1 nM or less. Optionally, an $IC_{50}$ assessment is performed to evaluate activity across a range of effective inhibitory concentrations, thereby allowing for robust comparison of the relative potencies of dsRNAs so assayed.

The dsRNA molecules of the invention are added directly, or can be complexed with lipids (e.g., cationic lipids), packaged within liposomes, or otherwise delivered to target cells or tissues. The nucleic acid or nucleic acid complexes can be locally administered to relevant tissues ex vivo, or in vivo through direct dermal application, transdermal application, or injection, with or without their incorporation in biopolymers. In particular embodiments, the nucleic acid molecules of the invention comprise sequences shown in FIG. 1, and the below exemplary structures. Examples of such nucleic acid molecules consist essentially of sequences defined in these figures and exemplary structures. Furthermore, where such agents are modified in accordance with the below description of modification patterning of DsiRNA agents, chemically modified forms of constructs described in FIG. 1, and the below exemplary structures can be used in all uses described for the DsiRNA agents of FIG. 1, and the below exemplary structures.

In another aspect, the invention provides mammalian cells containing one or more dsRNA molecules of this invention. The one or more dsRNA molecules can independently be targeted to the same or different sites.

By "RNA" is meant a molecule comprising at least one, and preferably at least 4, 8 and 12 ribonucleotide residues. The at least 4, 8 or 12 RNA residues may be contiguous. By "ribonucleotide" is meant a nucleotide with a hydroxyl group at the 2' position of a β-D-ribofuranose moiety. The terms include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the dsRNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

By "subject" is meant an organism, which is a donor or recipient of explanted cells or the cells themselves. "Subject" also refers to an organism to which the dsRNA agents of the invention can be administered. A subject can be a mammal or mammalian cells, including a human or human cells.

The phrase "pharmaceutically acceptable carrier" refers to a carrier for the administration of a therapeutic agent. Exemplary carriers include saline, buffered saline, dextrose, water, glycerol, ethanol, and combinations thereof. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. The pharmaceutically acceptable carrier of the disclosed dsRNA compositions may be micellar structures, such as a liposomes, capsids, capsoids, polymeric nanocapsules, or polymeric microcapsules.

Polymeric nanocapsules or microcapsules facilitate transport and release of the encapsulated or bound dsRNA into the cell. They include polymeric and monomeric materials, especially including polybutylcyanoacrylate. A summary of materials and fabrication methods has been published (see Kreuter, 1991). The polymeric materials which are formed from monomeric and/or oligomeric precursors in the polymerization/nanoparticle generation step, are per se known from the prior art, as are the molecular weights and molecular weight distribution of the polymeric material which a person skilled in the field of manufacturing nanoparticles may suitably select in accordance with the usual skill.

Various methodologies of the instant invention include step that involves comparing a value, level, feature, characteristic, property, etc. to a "suitable control", referred to interchangeably herein as an "appropriate control". A "suitable control" or "appropriate control" is a control or standard familiar to one of ordinary skill in the art useful for comparison purposes. In one embodiment, a "suitable control" or "appropriate control" is a value, level, feature, characteristic, property, etc. determined prior to performing an RNAi methodology, as described herein. For example, a transcription rate, mRNA level, translation rate, protein level, biological activity, cellular characteristic or property, genotype, phenotype, etc. can be determined prior to introducing an RNA silencing agent (e.g., DsiRNA) of the invention into a cell or organism. In another embodiment, a "suitable control" or "appropriate control" is a value, level, feature, characteristic, property, etc. determined in a cell or organism, e.g., a control or normal cell or organism, exhibiting, for example, normal traits. In yet another embodiment, a "suitable control" or "appropriate control" is a predefined value, level, feature, characteristic, property, etc.

The term "in vitro" has its art recognized meaning, e.g., involving purified reagents or extracts, e.g., cell extracts. The term "in vivo" also has its art recognized meaning, e.g., involving living cells, e.g., immortalized cells, primary cells, cell lines, and/or cells in an organism.

"Treatment", or "treating" as used herein, is defined as the application or administration of a therapeutic agent (e.g., a dsRNA agent or a vector or transgene encoding same) to a patient, or application or administration of a therapeutic agent to an isolated tissue or cell line from a patient, who has a disorder with the purpose to cure, heal, alleviate, relieve, alter, remedy, ameliorate, improve or affect the disease or disorder, or symptoms of the disease or disorder. The term "treatment" or "treating" is also used herein in the context of administering agents prophylactically. The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. The term "patient" includes human and other mammalian subjects that receive either prophylactic or therapeutic treatment.

Structures of Anti-Transthyretin DsiRNA Agents

In certain embodiments, the anti-transthyretin DsiRNA agents of the invention can have the following structures:

In one such embodiment, the DsiRNA comprises:

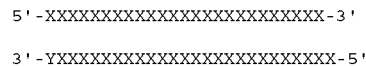

wherein "X"=RNA and "Y" is an overhang domain comprised of 1-4 RNA monomers that are optionally 2'-O-methyl RNA monomers. In a related embodiment, the DsiRNA comprises:

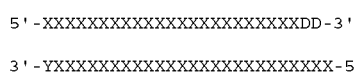

wherein "X"=RNA, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand.

DsiRNAs of the invention can carry a broad range of modification patterns (e.g., 2'-O-methyl RNA patterns, e.g., within extended DsiRNA agents). Certain modification patterns of the second strand of DsiRNAs of the invention are presented below.

In one embodiment, the DsiRNA comprises:

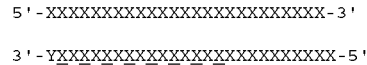

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

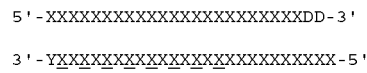

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers, and "D"=DNA. The top strand is the sense strand, and the bottom strand is the antisense strand.

In another such embodiment, the DsiRNA comprises:

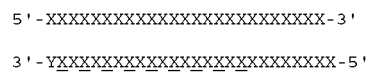

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

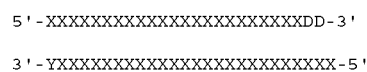

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In another such embodiment, the DsiRNA comprises:

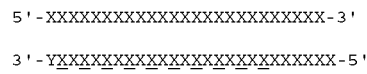

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

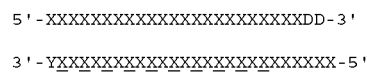

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In further embodiments, the DsiRNA comprises:

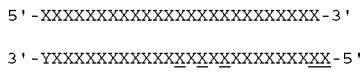

wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

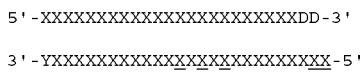

wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

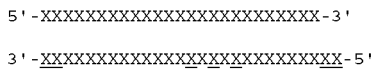

wherein "X"=RNA and "<u>X</u>"=2'-O-methyl RNA. In a further related embodiment, the DsiRNA comprises:

wherein "X"=RNA, "<u>X</u>"=2'-O-methyl RNA, and "D"=DNA. The top strand is the sense strand, and the bottom strand is the antisense strand. This modification pattern is also referred to herein as the "AS-M7" or "M7" modification pattern.

In additional embodiments, the DsiRNA comprises:

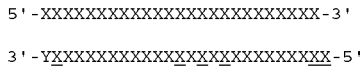

wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

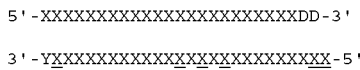

wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. The top strand is the sense strand, and the bottom strand is the antisense strand.

In another related embodiment, the DsiRNA comprises:

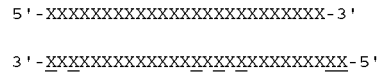

wherein "X"=RNA and "<u>X</u>"=2'-O-methyl RNA. The top strand is the sense strand, and the bottom strand is the antisense strand. In a further related embodiment, the DsiRNA comprises:

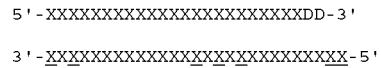

wherein "X"=RNA, "<u>X</u>"=2'-O-methyl RNA, and "D"=DNA. The top strand is the sense strand, and the bottom strand is the antisense strand. This modification pattern is also referred to herein as the "AS-M6" or "M6" modification pattern.

In other embodiments, the DsiRNA comprises:

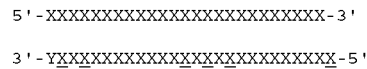

wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

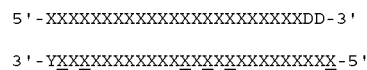

wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

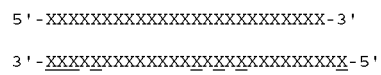

wherein "X"=RNA and "<u>X</u>"=2'-O-methyl RNA. The top strand is the sense strand, and the bottom strand is the antisense strand. In another related embodiment, the DsiRNA comprises:

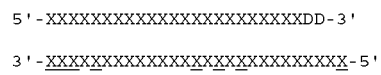

wherein "X"=RNA, "<u>X</u>"=2'-O-methyl RNA, and "D"=DNA. The top strand is the sense strand, and the bottom strand is the antisense strand. This modification pattern is also referred to herein as the "AS-M5" or "M5" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "<u>X</u>"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "<u>X</u>"=2'-O-methyl RNA, and "D"=DNA. The top strand is the sense strand, and the bottom strand is the antisense strand. This modification pattern is also referred to herein as the "AS-M4" or "M4" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "<u>X</u>"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "<u>X</u>"=2'-O-methyl RNA, and "D"=DNA. The top strand is the sense strand, and the bottom strand is the antisense strand. This modification pattern is also referred to herein as the "AS-M8" or "M8" modification pattern.

In other embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "<u>X</u>"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "<u>X</u>"=2'-O-methyl RNA, and "D"=DNA. The top strand is the sense strand, and the bottom strand is the antisense strand. This modification pattern is also referred to herein as the "AS-M3" or "M3" modification pattern.

In additional embodiments, the DsiRNA comprises:

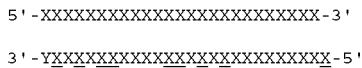

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

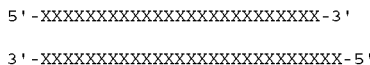

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M2" or "M2" modification pattern.

In further embodiments, the DsiRNA comprises:

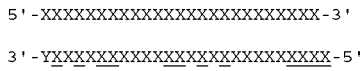

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

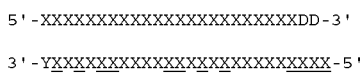

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

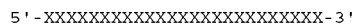

wherein "X"=RNA and "X"=2'-O-methyl RNA. The top strand is the sense strand, and the bottom strand is the antisense strand. In a further related embodiment, the DsiRNA comprises:

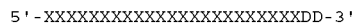
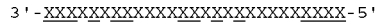

wherein "X"=RNA, "X"=2'-O-methyl RNA, and "D"=DNA. The top strand is the sense strand, and the bottom strand is the antisense strand. This modification pattern is also referred to herein as the "AS-M1" or "M1" modification pattern.

In additional embodiments, the DsiRNA comprises:

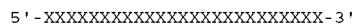
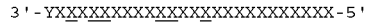

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

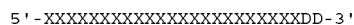
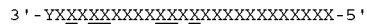

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

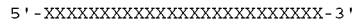

wherein "X"=RNA and "X"=2'-O-methyl RNA. The top strand is the sense strand, and the bottom strand is the antisense strand. In a further related embodiment, the DsiRNA comprises:

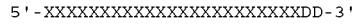
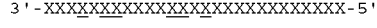

wherein "X"=RNA, "X"=2'-O-methyl RNA, and "D"=DNA. The top strand is the sense strand, and the bottom strand is the antisense strand. This modification pattern is also referred to herein as the "AS-M9" or "M9" modification pattern.

In other embodiments, the DsiRNA comprises:

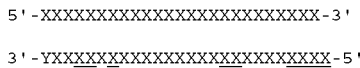

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

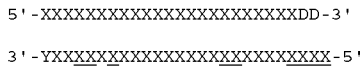

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

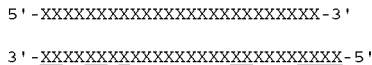

wherein "X"=RNA and "X̲"=2'-O-methyl RNA. The top strand is the sense strand, and the bottom strand is the antisense strand. In a further related embodiment, the DsiRNA comprises:

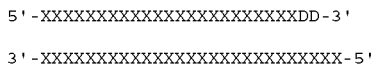

wherein "X"=RNA, "X̲"=2'-O-methyl RNA, and "D"=DNA. The top strand is the sense strand, and the bottom strand is the antisense strand. This modification pattern is also referred to herein as the "AS-M10" or "M10" modification pattern.

In further embodiments, the DsiRNA comprises:

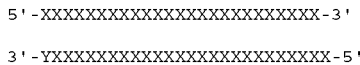

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

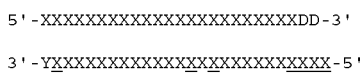

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

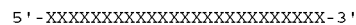
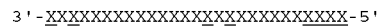

wherein "X"=RNA and "X̲"=2'-O-methyl RNA. The top strand is the sense strand, and the bottom strand is the antisense strand. In a further related embodiment, the DsiRNA comprises:

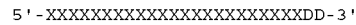
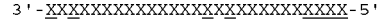

wherein "X"=RNA, "X̲"=2'-O-methyl RNA, and "D"=DNA. The top strand is the sense strand, and the bottom strand is the antisense strand. This modification pattern is also referred to herein as the "AS-M11" or "M11" modification pattern.

In additional embodiments, the DsiRNA comprises:

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

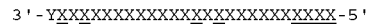

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

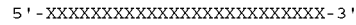
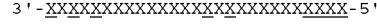

wherein "X"=RNA and "X̲"=2'-O-methyl RNA. The top strand is the sense strand, and the bottom strand is the antisense strand. In a further related embodiment, the DsiRNA comprises:

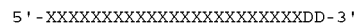
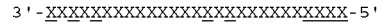

wherein "X"=RNA, "X̲"=2'-O-methyl RNA, and "D"=DNA. The top strand is the sense strand, and the bottom strand is the antisense strand. This modification pattern is also referred to herein as the "AS-M12" or "M12" modification pattern.

In further embodiments, the DsiRNA comprises:

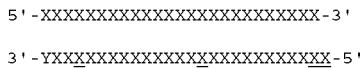

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

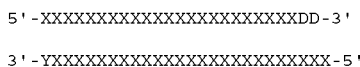

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

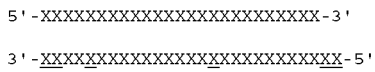

wherein "X"=RNA and "X"=2'-O-methyl RNA. The top strand is the sense strand, and the bottom strand is the antisense strand. In a further related embodiment, the DsiRNA comprises:

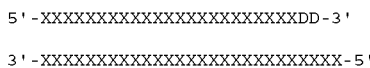

wherein "X"=RNA, "X"=2'-O-methyl RNA, and "D"=DNA. The top strand is the sense strand, and the bottom strand is the antisense strand. This modification pattern is also referred to herein as the "AS-M13" or "M13" modification pattern.

In other embodiments, the DsiRNA comprises:

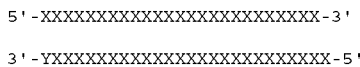

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In another related embodiment, the DsiRNA comprises:

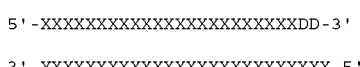

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

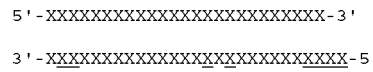

wherein "X"=RNA and "X"=2'-O-methyl RNA. The top strand is the sense strand, and the bottom strand is the antisense strand. In a further related embodiment, the DsiRNA comprises:

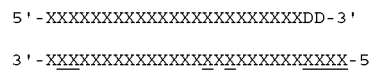

wherein "X"=RNA, "X"=2'-O-methyl RNA, and "D"=DNA. The top strand is the sense strand, and the bottom strand is the antisense strand. This modification pattern is also referred to herein as the "AS-M21" or "M21" modification pattern.

In further embodiments, the DsiRNA comprises:

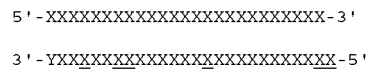

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

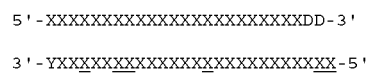

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M14" or "M14" modification pattern.

In additional embodiments, the DsiRNA comprises:

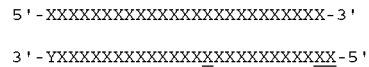

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M15" or "M15" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M16" or "M16" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M17" or "M17" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

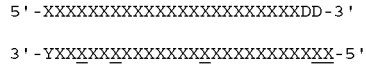

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

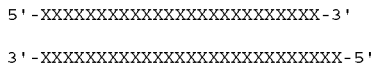

wherein "X"=RNA and "X̲"=2'-O-methyl RNA. The top strand is the sense strand, and the bottom strand is the antisense strand. In a further related embodiment, the DsiRNA comprises:

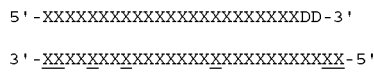

wherein "X"=RNA, "X̲"=2'-O-methyl RNA, and "D"=DNA. The top strand is the sense strand, and the bottom strand is the antisense strand. This modification pattern is also referred to herein as the "AS-M18" or "M18" modification pattern.

In additional embodiments, the DsiRNA comprises:

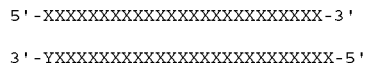

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

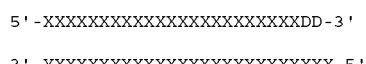

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

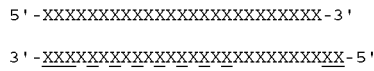

wherein "X"=RNA and "X̲"=2'-O-methyl RNA. The top strand is the sense strand, and the bottom strand is the antisense strand. In a further related embodiment, the DsiRNA comprises:

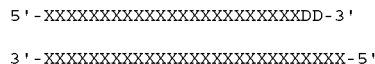

wherein "X"=RNA, "X̲"=2'-O-methyl RNA, and "D"=DNA. The top strand is the sense strand, and the bottom strand is the antisense strand. This modification pattern is also referred to herein as the "AS-M19" or "M19" modification pattern.

In further embodiments, the DsiRNA comprises:

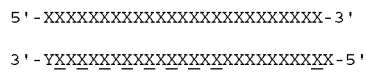

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

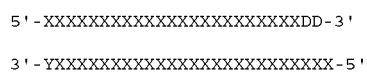

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

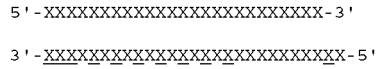

wherein "X"=RNA and "X̲"=2'-O-methyl RNA. The top strand is the sense strand, and the bottom strand is the antisense strand. In a further related embodiment, the DsiRNA comprises:

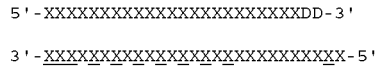

wherein "X"=RNA, "X̲"=2'-O-methyl RNA, and "D"=DNA. The top strand is the sense strand, and the bottom strand is the antisense strand. This modification pattern is also referred to herein as the "AS-M20" or "M20" modification pattern.

In additional embodiments, the DsiRNA comprises:

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXX-3'

3'-XXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M22" or "M22" modification pattern.

In further embodiments, the DsiRNA comprises:

5'-XXXXXXXXXXXXXXXXXXXXXXX-3'

3'-YXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXX-3'

3'-XXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M25" or "M25" modification pattern.

In further embodiments, the DsiRNA comprises:

5'-XXXXXXXXXXXXXXXXXXXXXXX-3'

3'-YXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M26" or "M26" modification pattern.

In additional embodiments, the DsiRNA comprises:

5'-XXXXXXXXXXXXXXXXXXXXXXXXX-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M27" or "M27" modification pattern.

In further embodiments, the DsiRNA comprises:

5'-XXXXXXXXXXXXXXXXXXXXXXXXX-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M28" or "M28" modification pattern.

In further embodiments, the DsiRNA comprises:

5'-XXXXXXXXXXXXXXXXXXXXXXXXX-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M29" or "M29" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M30" or "M30" modification pattern.

In further embodiments, the DsiRNA comprises:

```
5'-XXXXXXXXXXXXXXXXXXXXXXXXX-3'

3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M31" or "M31" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M32" or "M32" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M34" or "M34" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-Y<u>X</u>XX<u>X</u>XX<u>X</u>XXXXXX<u>X</u>XXXXXXXX<u>XXXX</u>-5' wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-<u>XXXX</u>X<u>X</u>XX<u>X</u>XXXXXX<u>X</u>XXXXXXXX<u>XXXX</u>-5' wherein "X"=RNA and "<u>X</u>"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-<u>XXXX</u>X<u>X</u>XX<u>X</u>XXXXXX<u>X</u>XXXXXXXX<u>XXXX</u>-5' wherein "X"=RNA, "<u>X</u>"=2'-O-methyl RNA, and "D"=DNA. The top strand is the sense strand, and the bottom strand is the antisense strand. This modification pattern is also referred to herein as the "AS-M35" or "M35" modification pattern.

In further embodiments, the DsiRNA comprises:

5'-XXXXXXXXXXXXXXXXXXXXXXXXX-3'

3'-Y<u>X</u>XX<u>X</u>XXXXXXXXXXXXXXXXXX<u>XX</u>-5' wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-Y<u>X</u>XX<u>X</u>XXXXXXXXXXXXXXXXXX<u>XX</u>-5' wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-<u>XXXX</u>X<u>X</u>XXXXXXXXXXXXXXXXXX<u>XX</u>-5' wherein "X"=RNA and "<u>X</u>"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-<u>XXXX</u>X<u>X</u>XXXXXXXXXXXXXXXXXX<u>XX</u>-5' wherein "X"=RNA, "<u>X</u>"=2'-O-methyl RNA, and "D"=DNA. The top strand is the sense strand, and the bottom strand is the antisense strand. This modification pattern is also referred to herein as the "AS-M37" or "M37" modification pattern.

In additional embodiments, the DsiRNA comprises:

5'-XXXXXXXXXXXXXXXXXXXXXXXXX-3'

3'-Y<u>XX</u>X<u>X</u>XXXXXXXXXXXXXXXXXXXX-5' wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-Y<u>XX</u>X<u>X</u>XXXXXXXXXXXXXXXXXXXX-5' wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-<u>XXXX</u>X<u>X</u>XXXXXXXXXXXXXXXXXXXX-5' wherein "X"=RNA and "<u>X</u>"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'

3'-<u>XXXX</u>X<u>X</u>XXXXXXXXXXXXXXXXXXXX-5' wherein "X"=RNA, "<u>X</u>"=2'-O-methyl RNA, and "D"=DNA. The top strand is the sense strand, and the bottom strand is the antisense strand. This modification pattern is also referred to herein as the "AS-M38" or "M38" modification pattern.

In further embodiments, the DsiRNA comprises:

5'-XXXXXXXXXXXXXXXXXXXXXXXXX-3'

3'-Y<u>X</u>XXXXXXXXXXXXXXXXXXXXXX<u>XX</u>-5' wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXDD-3'

3'-Y<u>X</u>XXXXXXXXXXXXXXXXXXXXXX<u>XX</u>-5' wherein "X"=RNA, "<u>X</u>"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M40" or "M40" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M41" or "M41" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M36" or "M36" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

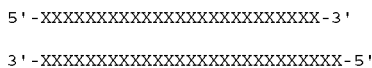

wherein "X"=RNA and "X"=2'-O-methyl RNA. The top strand is the sense strand, and the bottom strand is the antisense strand. In a further related embodiment, the DsiRNA comprises:

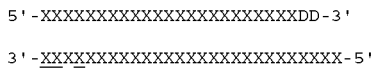

wherein "X"=RNA, "X"=2'-O-methyl RNA, and "D"=DNA. The top strand is the sense strand, and the bottom strand is the antisense strand. This modification pattern is also referred to herein as the "AS-M42" or "M42" modification pattern.

In further embodiments, the DsiRNA comprises:

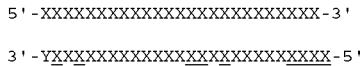

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

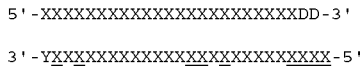

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

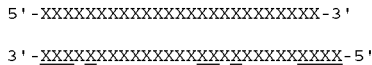

wherein "X"=RNA and "X"=2'-O-methyl RNA. The top strand is the sense strand, and the bottom strand is the antisense strand. In a further related embodiment, the DsiRNA comprises:

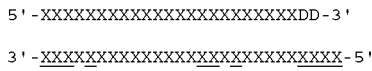

wherein "X"=RNA, "X"=2'-O-methyl RNA, and "D"=DNA. The top strand is the sense strand, and the bottom strand is the antisense strand. This modification pattern is also referred to herein as the "AS-M43" or "M43" modification pattern.

In additional embodiments, the DsiRNA comprises:

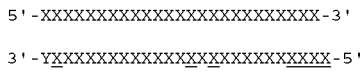

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

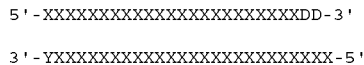

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

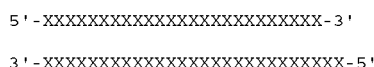

wherein "X"=RNA and "X"=2'-O-methyl RNA. The top strand is the sense strand, and the bottom strand is the antisense strand. In a further related embodiment, the DsiRNA comprises:

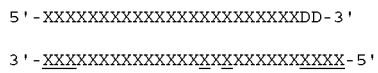

wherein "X"=RNA, "X"=2'-O-methyl RNA, and "D"=DNA. The top strand is the sense strand, and the bottom strand is the antisense strand. This modification pattern is also referred to herein as the "AS-M44" or "M44" modification pattern.

In further embodiments, the DsiRNA comprises:

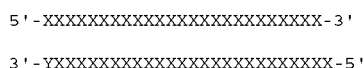

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

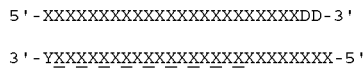

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

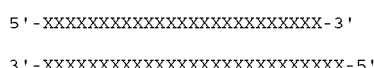

wherein "X"=RNA and "X"=2'-O-methyl RNA. The top strand is the sense strand, and the bottom strand is the antisense strand. In a further related embodiment, the DsiRNA comprises:

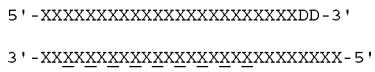

wherein "X"=RNA, "X"=2'-O-methyl RNA, and "D"=DNA. The top strand is the sense strand, and the bottom strand is the antisense strand. This modification pattern is also referred to herein as the "AS-M45" or "M45" modification pattern.

In additional embodiments, the DsiRNA comprises:

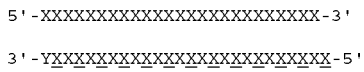

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

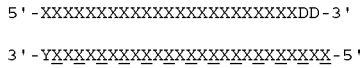

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

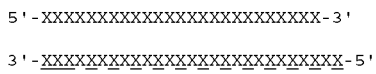

wherein "X"=RNA and "X"=2'-O-methyl RNA. The top strand is the sense strand, and the bottom strand is the antisense strand. In a further related embodiment, the DsiRNA comprises:

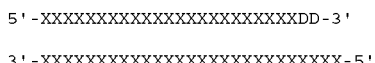

wherein "X"=RNA, "X"=2'-O-methyl RNA, and "D"=DNA. The top strand is the sense strand, and the bottom strand is the antisense strand. This modification pattern is also referred to herein as the "AS-M46" or "M46" modification pattern.

In further embodiments, the DsiRNA comprises:

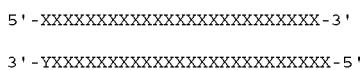

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

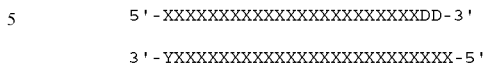

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

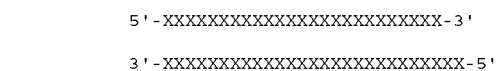

wherein "X"=RNA and "X"=2'-O-methyl RNA. The top strand is the sense strand, and the bottom strand is the antisense strand. In a further related embodiment, the DsiRNA comprises:

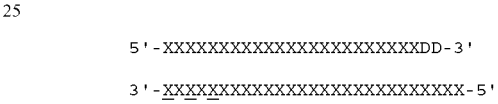

wherein "X"=RNA, "X"=2'-O-methyl RNA, and "D"=DNA. The top strand is the sense strand, and the bottom strand is the antisense strand. This modification pattern is also referred to herein as the "AS-M47" or "M47" modification pattern.

In additional embodiments, the DsiRNA comprises:

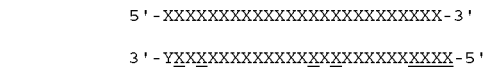

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

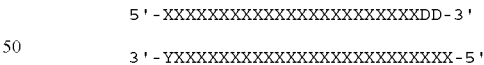

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

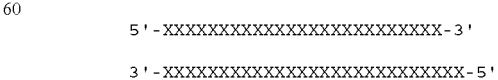

wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M48" or "M48" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M52" or "M52" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M54" or "M54" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M55" or "M55" modification pattern.

In further embodiments, the DsiRNA comprises:

```
5'-XXXXXXXXXXXXXXXXXXXXXXXXX-3'
3'-YX̲XX̲XX̲XX̲XX̲XX̲XX̲XX̲XX̲XX̲XX̲XX̲X̲X̲X̲X̲-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YX̲XX̲XX̲XX̲XX̲XX̲XX̲XX̲XX̲XX̲XX̲XX̲X̲X̲X̲X̲-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-X̲XX̲XX̲XX̲XX̲XX̲XX̲XX̲XX̲XX̲XX̲XX̲XX̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-X̲XX̲XX̲XX̲XX̲XX̲XX̲XX̲XX̲XX̲XX̲XX̲XX̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M56" or "M56" modification pattern.

In additional embodiments, the DsiRNA comprises:

```
5'-XXXXXXXXXXXXXXXXXXXXXXXXX-3'
3'-YX̲XX̲XX̲XX̲XX̲XX̲XX̲XX̲XX̲XX̲XX̲XX̲X̲X̲X̲X̲-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YX̲XX̲XX̲XX̲XX̲XX̲XX̲XX̲XX̲XX̲XX̲XX̲X̲X̲X̲X̲-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-X̲XX̲XX̲XX̲XX̲XX̲XX̲XX̲XX̲XX̲XX̲XX̲XX̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-X̲XX̲XX̲XX̲XX̲XX̲XX̲XX̲XX̲XX̲XX̲XX̲XX̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M57" or "M57" modification pattern.

In further embodiments, the DsiRNA comprises:

```
5'-XXXXXXXXXXXXXXXXXXXXXXXXX-3'
3'-YX̲XX̲XX̲XX̲XX̲XX̲XX̲XX̲XX̲XX̲XX̲XX̲X̲X̲X̲X̲-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YX̲XX̲XX̲XX̲XX̲XX̲XX̲XX̲XX̲XX̲XX̲XX̲X̲X̲X̲X̲-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-X̲XX̲XX̲XX̲XX̲XX̲XX̲XX̲XX̲XX̲XX̲XX̲XX̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-X̲XX̲XX̲XX̲XX̲XX̲XX̲XX̲XX̲XX̲XX̲XX̲XX̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M58" or "M58" modification pattern.

In additional embodiments, the DsiRNA comprises:

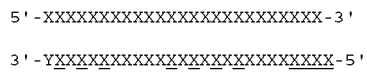

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

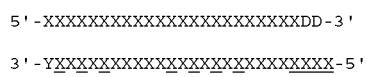

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

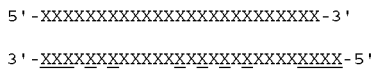

wherein "X"=RNA and "X"=2'-O-methyl RNA. The top strand is the sense strand, and the bottom strand is the antisense strand. In a further related embodiment, the DsiRNA comprises:

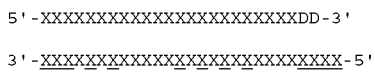

wherein "X"=RNA, "X"=2'-O-methyl RNA, and "D"=DNA. The top strand is the sense strand, and the bottom strand is the antisense strand. This modification pattern is also referred to herein as the "AS-M59" or "M59" modification pattern.

In further embodiments, the DsiRNA comprises:

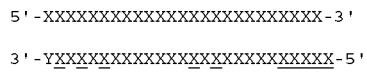

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

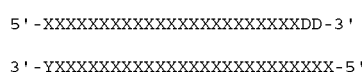

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

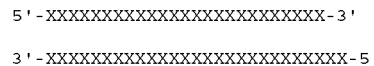

wherein "X"=RNA and "X"=2'-O-methyl RNA. The top strand is the sense strand, and the bottom strand is the antisense strand. In a further related embodiment, the DsiRNA comprises:

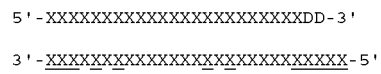

wherein "X"=RNA, "X"=2'-O-methyl RNA, and "D"=DNA. The top strand is the sense strand, and the bottom strand is the antisense strand. This modification pattern is also referred to herein as the "AS-M60" or "M60" modification pattern.

In additional embodiments, the DsiRNA comprises:

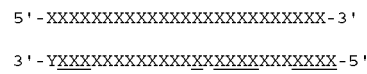

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

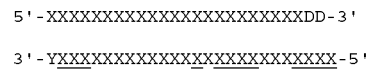

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

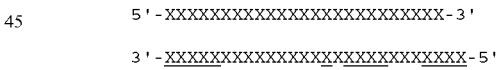

wherein "X"=RNA and "X"=2'-O-methyl RNA. The top strand is the sense strand, and the bottom strand is the antisense strand. In a further related embodiment, the DsiRNA comprises:

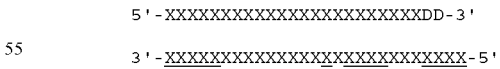

wherein "X"=RNA, "X"=2'-O-methyl RNA, and "D"=DNA. The top strand is the sense strand, and the bottom strand is the antisense strand. This modification pattern is also referred to herein as the "AS-M61" or "M61" modification pattern.

In further embodiments, the DsiRNA comprises:

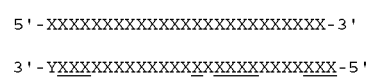

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

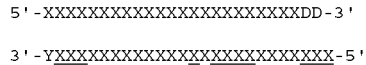

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

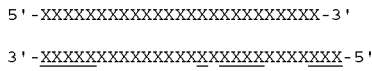

wherein "X"=RNA and "X"=2'-O-methyl RNA. The top strand is the sense strand, and the bottom strand is the antisense strand. In a further related embodiment, the DsiRNA comprises:

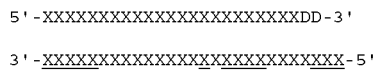

wherein "X"=RNA, "X"=2'-O-methyl RNA, and "D"=DNA. The top strand is the sense strand, and the bottom strand is the antisense strand. This modification pattern is also referred to herein as the "AS-M62" or "M62" modification pattern.

In additional embodiments, the DsiRNA comprises:

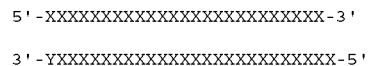

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

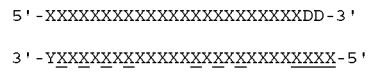

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

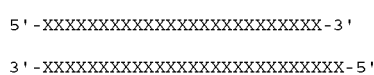

wherein "X"=RNA and "X"=2'-O-methyl RNA. The top strand is the sense strand, and the bottom strand is the antisense strand. In a further related embodiment, the DsiRNA comprises:

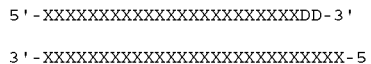

wherein "X"=RNA, "X"=2'-O-methyl RNA, and "D"=DNA. The top strand is the sense strand, and the bottom strand is the antisense strand. This modification pattern is also referred to herein as the "AS-M63" or "M63" modification pattern.

In further embodiments, the DsiRNA comprises:

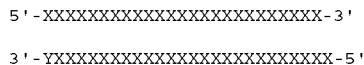

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

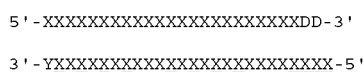

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

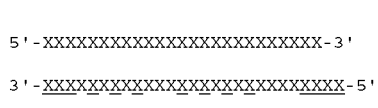

wherein "X"=RNA and "X"=2'-O-methyl RNA. The top strand is the sense strand, and the bottom strand is the antisense strand. In a further related embodiment, the DsiRNA comprises:

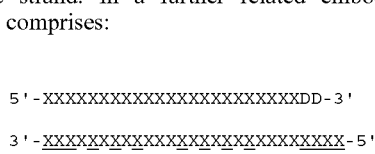

wherein "X"=RNA, "X"=2'-O-methyl RNA, and "D"=DNA. The top strand is the sense strand, and the bottom strand is the antisense strand. This modification pattern is also referred to herein as the "AS-M64" or "M64" modification pattern.

In additional embodiments, the DsiRNA comprises:

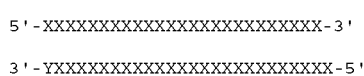

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

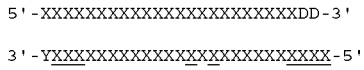

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

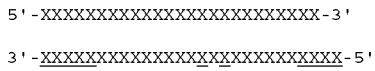

wherein "X"=RNA and "X̲"=2'-O-methyl RNA. The top strand is the sense strand, and the bottom strand is the antisense strand. In a further related embodiment, the DsiRNA comprises:

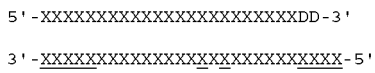

wherein "X"=RNA, "X̲"=2'-O-methyl RNA, and "D"=DNA. The top strand is the sense strand, and the bottom strand is the antisense strand. This modification pattern is also referred to herein as the "AS-M65" or "M65" modification pattern.

In further embodiments, the DsiRNA comprises:

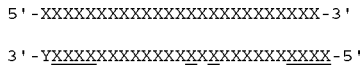

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

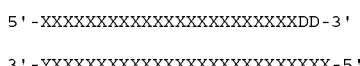

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X̲"=2'-O-methyl RNA. The top strand is the sense strand, and the bottom strand is the antisense strand. In a further related embodiment, the DsiRNA comprises:

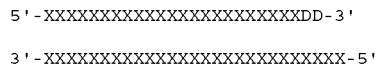

wherein "X"=RNA, "X̲"=2'-O-methyl RNA, and "D"=DNA. The top strand is the sense strand, and the bottom strand is the antisense strand. This modification pattern is also referred to herein as the "AS-M66" or "M66" modification pattern.

In additional embodiments, the DsiRNA comprises:

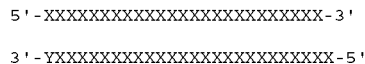

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

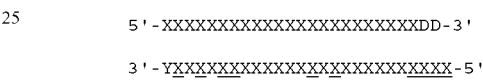

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

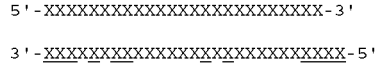

wherein "X"=RNA and "X̲"=2'-O-methyl RNA. The top strand is the sense strand, and the bottom strand is the antisense strand. In a further related embodiment, the DsiRNA comprises:

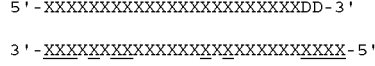

wherein "X"=RNA, "X̲"=2'-O-methyl RNA, and "D"=DNA. The top strand is the sense strand, and the bottom strand is the antisense strand. This modification pattern is also referred to herein as the "AS-M67" or "M67" modification pattern.

In further embodiments, the DsiRNA comprises:

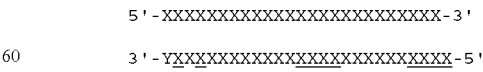

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M68" or "M68" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M69" or "M69" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M70" or "M70" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M71" or "M71" modification pattern.

In further embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

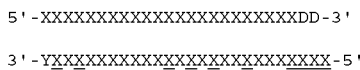

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

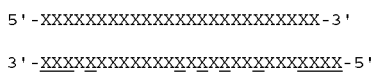

wherein "X"=RNA and "X"=2'-O-methyl RNA. The top strand is the sense strand, and the bottom strand is the antisense strand. In a further related embodiment, the DsiRNA comprises:

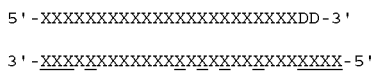

wherein "X"=RNA, "X"=2'-O-methyl RNA, and "D"=DNA. The top strand is the sense strand, and the bottom strand is the antisense strand. This modification pattern is also referred to herein as the "AS-M72" or "M72" modification pattern.

In additional embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

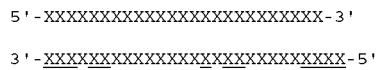

wherein "X"=RNA and "X"=2'-O-methyl RNA. The top strand is the sense strand, and the bottom strand is the antisense strand. In a further related embodiment, the DsiRNA comprises:

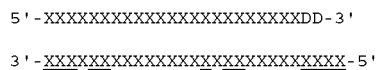

wherein "X"=RNA, "X"=2'-O-methyl RNA, and "D"=DNA. The top strand is the sense strand, and the bottom strand is the antisense strand. This modification pattern is also referred to herein as the "AS-M73" or "M73" modification pattern.

In additional embodiments, the DsiRNA comprises:

wherein "X"=RNA and "X"=2'-O-methyl RNA. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M7*" or "M7*" modification pattern.

In further embodiments, the DsiRNA comprises:

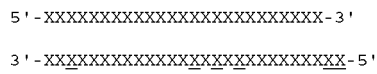

wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M6*" or "M6*" modification pattern.

In other embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In another related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M5*" or "M5*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M4*" or "M4*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M8*" or "M8*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M2*" or "M2*" modification pattern.

In other embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M10*" or "M10*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M11*" or "M11*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M13*" or "M13*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M14*" or "M14*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M15*" or "M15*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M16*" or "M16*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M17*" or "M17*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M18*" or "M18*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M19*" or "M19*" modification pattern.

In further embodiments, the DsiRNA comprises:

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

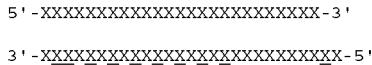

wherein "X"=RNA and "X̲"=2'-O-methyl RNA. The top strand is the sense strand, and the bottom strand is the antisense strand. In a further related embodiment, the DsiRNA comprises:

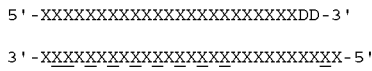

wherein "X"=RNA, "X̲"=2'-O-methyl RNA, and "D"=DNA. The top strand is the sense strand, and the bottom strand is the antisense strand. This modification pattern is also referred to herein as the "AS-M20*" or "M20*" modification pattern.

In additional embodiments, the DsiRNA comprises:

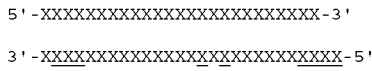

wherein "X"=RNA and "X̲"=2'-O-methyl RNA. The top strand is the sense strand, and the bottom strand is the antisense strand. In a further related embodiment, the DsiRNA comprises:

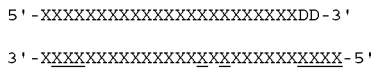

wherein "X"=RNA, "X̲"=2'-O-methyl RNA, and "D"=DNA. The top strand is the sense strand, and the bottom strand is the antisense strand. This modification pattern is also referred to herein as the "AS-M22*" or "M22*" modification pattern.

In further embodiments, the DsiRNA comprises:

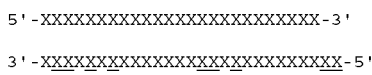

wherein "X"=RNA and "X̲"=2'-O-methyl RNA. The top strand is the sense strand, and the bottom strand is the antisense strand. In a further related embodiment, the DsiRNA comprises:

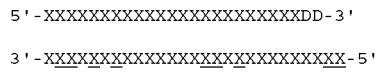

wherein "X"=RNA, "X̲"=2'-O-methyl RNA, and "D"=DNA. The top strand is the sense strand, and the bottom strand is the antisense strand. This modification pattern is also referred to herein as the "AS-M24*" or "M24*" modification pattern.

In additional embodiments, the DsiRNA comprises:

wherein "X"=RNA and "X̲"=2'-O-methyl RNA. The top strand is the sense strand, and the bottom strand is the antisense strand. In a further related embodiment, the DsiRNA comprises:

wherein "X"=RNA, "X̲"=2'-O-methyl RNA, and "D"=DNA. The top strand is the sense strand, and the bottom strand is the antisense strand. This modification pattern is also referred to herein as the "AS-M25*" or "M25*" modification pattern.

In further embodiments, the DsiRNA comprises:

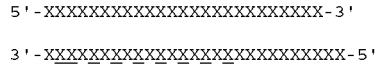

wherein "X"=RNA and "X̲"=2'-O-methyl RNA. The top strand is the sense strand, and the bottom strand is the antisense strand. In a further related embodiment, the DsiRNA comprises:

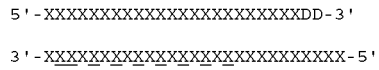

wherein "X"=RNA, "X̲"=2'-O-methyl RNA, and "D"=DNA. The top strand is the sense strand, and the bottom strand is the antisense strand. This modification pattern is also referred to herein as the "AS-M26*" or "M26*" modification pattern.

In additional embodiments, the DsiRNA comprises:

wherein "X"=RNA and "X̲"=2'-O-methyl RNA. The top strand is the sense strand, and the bottom strand is the antisense strand. In a further related embodiment, the DsiRNA comprises:

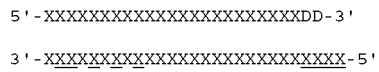

wherein "X"=RNA, "X̲"=2'-O-methyl RNA, and "D"=DNA. The top strand is the sense strand, and the bottom strand is the antisense strand. This modification pattern is also referred to herein as the "AS-M27*" or "M27*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M28*" or "M28*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M29*" or "M29*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M34*" or "M34*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M35*" or "M35*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M37*" or "M37*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M38*" or "M38*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XX̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M40*" or "M40*" modification pattern.

In additional embodiments, the DsiRNA comprises:

```
5'-XXXXXXXXXXXXXXXXXXXXXXXXX-3'
3'-XX̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XX̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M41*" or "M41*" modification pattern.

In further embodiments, the DsiRNA comprises:

```
5'-XXXXXXXXXXXXXXXXXXXXXXXXX-3'
3'-XX̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XX̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M36*" or "M36*" modification pattern.

In additional embodiments, the DsiRNA comprises:

```
5'-XXXXXXXXXXXXXXXXXXXXXXXXX-3'
3'-XX̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XX̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M42*" or "M42*" modification pattern.

In further embodiments, the DsiRNA comprises:

```
5'-XXXXXXXXXXXXXXXXXXXXXXXXX-3'
3'-XX̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XX̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M43*" or "M43*" modification pattern.

In additional embodiments, the DsiRNA comprises:

```
5'-XXXXXXXXXXXXXXXXXXXXXXXXX-3'
3'-XX̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XX̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M44*" or "M44*" modification pattern.

In further embodiments, the DsiRNA comprises:

```
5'-XXXXXXXXXXXXXXXXXXXXXXXXX-3'
3'-XX̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XX̲X̲X̲X̲X̲X̲X̲X̲X̲X̲X̲X̲X̲X̲X̲X̲X̲X̲X̲X̲X̲X̲X̲X̲X̲X̲X̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M46*" or "M46*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M47*" or "M47*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M48*" or "M48*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M52*" or "M52*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M54*" or "M54*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M55*" or "M55*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M56*" or "M56*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M57*" or "M57*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M58*" or "M58*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M59*" or "M59*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M60*" or "M60*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M61*" or "M61*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M62*" or "M62*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M63*" or "M63*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M64*" or "M64*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M65*" or "M65*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M66*" or "M66*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M67*" or "M67*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M68*" or "M68*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M69*" or "M69*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M70*" or "M70*" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M71*" or "M71*" modification pattern.

In further embodiments, the DsiRNA comprises:

```
5'-XXXXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M72*" or "M72*" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M73*" or "M73*" modification pattern.

Additional exemplary antisense strand modifications include the following:

```
3'-XXXXXXXXXXXXXXXXXXXXXXXXXXXX-5'       "AS-M74"
3'-XXXXXXXXXXXXXXXXXXXXXXXXXXXX-5'       "AS-M75"
3'-XXXXXXXXXXXXXXXXXXXXXXXXXXXX-5'       "AS-M76"
3'-XXXXXXXXXXXXXXXXXXXXXXXXXXXX-5'       "AS-M77"
3'-XXXXXXXXXXXXXXXXXXXXXXXXXXXX-5'       "AS-M78"
3'-XXXXXXXXXXXXXXXXXXXXXXXXXXXX-5'       "AS-M79"
3'-XXXXXXXXXXXXXXXXXXXXXXXXXXXX-5'       "AS-M80"
3'-XXXXXXXXXXXXXXXXXXXXXXXXXXXX-5'       "AS-M81"
3'-XpXXXXXXXXXXXXXXXXXXXXXXXXXX-5'       "AS-M82"
3'-XpXXXXXXXXXXXXXXXXXXXXXXXXXX-5'       "AS-M83"
3'-XXXXXXXXXXXXXXXXXXXXXXXXXXXX-5'       "AS-M84"
3'-XXXXXXXXXXXXXXXXXXXXXXXXXXXX-5'       "AS-M85"
3'-FFFXXXXXXXXXXXXXXXXXXXXXFFFF-5'       "AS-M88"
3'-XXXXFXXXFXFXXXXXXXXXXXXXXXX-5'        "AS-M89"
3'-FFFXFXFXFXFXFXFXXXXXXXXFFFF-5'        "AS-M90"
3'-FFFXXXXXXXXXXXXXXXXXXXXXXFF-5'        "AS-M91"
3'-XXXXXXFXXXXXFXFXXXXXXXXXXXX-5'        "AS-M92"
3'-FFFXFXXXXXXXXXXXFXXXXXXXXXX-5'        "AS-M93"
3'-FFFXFXFXXXXXFXFXFXXXXXXFFFF-5'        "AS-M94"
3'-FFFXFXFXFXFXFXFXFXXXXXXFFFF-5'        "AS-M95"
3'-FFFXFXFXFXFXFXFXFXXXXXXFFFpF-5'       "AS-M96"
3'-XXXXXXXXXXXXXXXXXXXXXXXXXXXX-5'       "AS-M210"

3'-XXXXXXXXXXXXXXXXXXXXXXXXXXXX-5'       "AS-M74*"
3'-XXXXXXXXXXXXXXXXXXXXXXXXXXXX-5'       "AS-M75*"
3'-XXXXXXXXXXXXXXXXXXXXXXXXXXXX-5'       "AS-M76*"
3'-XXXXXXXXXXXXXXXXXXXXXXXXXXXX-5'       "AS-M77*"
3'-XXXXXXXXXXXXXXXXXXXXXXXXXXXX-5'       "AS-M78*"
3'-XXXXXXXXXXXXXXXXXXXXXXXXXXXX-5'       "AS-M79*"
3'-XXXXXXXXXXXXXXXXXXXXXXXXXXXX-5'       "AS-M80*"
3'-XpXXXXXXXXXXXXXXXXXXXXXXXXXX-5'       "AS-M82*"
3'-XpXXXXXXXXXXXXXXXXXXXXXXXXXX-5'       "AS-M83*"
3'-XXXXXXXXXXXXXXXXXXXXXXXXXXXX-5'       "AS-M84*"
3'-XFFXXXXXXXXXXXXXXXXXXXXXFFFF-5'       "AS-M88*"
3'-XXXXFXXFXFXXXXXXXXXXXXXXXX-5'         "AS-M89*"
3'-XFFXFXFXFXFXFXFXXXXXXXFFFF-5'         "AS-M90*"
```

-continued

```
3'-XFFXXXXXXXXXXXXXXXXXXXXXFF-5'            "AS-M91*"
3'-XXXXXXFXXXXXFXFXXXXXXXXXXX-5'            "AS-M92*"
3'-XFFXFXXXXXXXXXXXFXXXXXXXXX-5'            "AS-M93*"
3'-XFFXFXFXXXXXFXFXFXXXXFFFF-5'             "AS-M94*"
3'-XFFXFXFXFXFXFXFXFXXXXXFFFF-5'            "AS-M95*"
3'-XFFXFXFXFXFXFXFXFXXXXXFFFpF-5'           "AS-M96*"
3'-XXXXXXXXXXXXXXXXXXXXXXXXXX-5'            "AS-M210*"

3'-XpXXXXXXXXXXXXXXXXXXXXXXXXpX-5'          "AS-M101"
3'-XpXXXXXXXXXXXXXXXXXXXXXXXXpX-5'          "AS-M104"
3'-XpXXXXXXXXXXXXXXXXXXXXXXXXpX-5'          "AS-M104*"
3'-XpFpXFXFXFXFXFXFXFXFXFFXXXpX-5'          "AS-M105"
3'-XpFpXFXFXFXFXFXFXFXFXFFXXXpX-5'          "AS-M105*"
3'-XpXXXXXXXXXXXXXXXXXXXXXXXXpX-5'          "AS-M106"
3'-XpXXXXXXXXXXXXXXXXXXXXXXXXpX-5'          "AS-M106*"
3'-XXpXXXXXXXXXXXXXXXXXXXXXXXX-5'           "AS-M107"
3'-XXpXXXXXXXXXXXXXXXXXXXXXXXX-5'           "AS-M107*"
3'-ba-XXXXXXXXXXXXXXXXXXXXXXXXX-5'          "AS-M108" (ba = inverted
                                            abasic for F7 stabilization at 3' end)
3'-ba-XXXXXXXXXXXXXXXXXXXXXXXXXX-5'         "AS-M108*" (ba = inverted
                                            abasic for F7 stabilization at 3' end)
3'-XDXXXXXXXXXXXXXXXXXXXXXXXXX-5'           "AS-M109"
3'-XpXXFXFXFXXXXXXXXXXXXXXXpX-5'            "AS-M110"
3'-XpXXFXFXFXXXXXXXXXXXXXXXpX-5'            "AS-M110*"
3'-XpXXFXFXFXXXXXFXFXFXXXXXXpX-5'           "AS-M111"
3'-XpXXFXFXFFXXXXXXXXFXXXXXXpX-5'           "AS-M112"
3'-XpXXFXFXFFXXFXXXXXXFXXXXXpX-5'           "AS-M113"
3'-XpXXFXFXFFFFXXXXXXFXXXXXpX-5'            "AS-M114"
3'-XpXXFXFXFFFFXXXXXXFXXFXXXpX-5'           "AS-M115"
3'-XpXXFXFXFFFFFXXXXXXFFFXXXpX-5'           "AS-M116"
3'-XpFXFXFXFXFXFXFXFXFXFXFXFpX-5'           "AS-M117"
3'-XpXXFXFXFXXXXXFXFXFXXXXXpX-5'            "AS-M111*"
3'-XpXXFXFXFFXXXXXXXXFXXXXXpX-5'            "AS-M112*"
3'-XpXXFXFXFFXXFXXXXXXFXXXXXpX-5'           "AS-M113*"
3'-XpXXFXFXFFFFXXXXXXFXXXXXpX-5'            "AS-M114*"
3'-XpXXFXFXFFFFXXXXXXFXXFXXXpX-5'           "AS-M115*"
3'-XpXXFXFXFFFFFXXXXXXFFFFXXXpX-5'          "AS-M116*"
3'-XpFXFXFXFXFXFXFXFXFXFXFXFpX-5'           "AS-M117*"

3'-XpXXXXXXXXXXXXXXXXXXXXXXXpX-5'           "AS-M120"
3'-XpXXXXXXXXXXXXXXXXXXXXXXXpX-5'           "AS-M121"
3'-XpXXXXXXXXXXXXXXXXXXXXXXXpX-5'           "AS-M122"
3'-XpXXXXXXXXXXXXXXXXXXXXXXXpX-5'           "AS-M123"
3'-XpXXXXXXXXXXXXXXXXXXXXXXXpX-5'           "AS-M124"
3'-XpXXXXXXXXXXXXXXXXXXXXXXXpX-5'           "AS-M125"
3'-XpFpXFXFXFXXXXXFXFXFXXXXFXFpX-5'         "AS-M126"
3'-XpFpXFXFXFXXXXXFXFXFXXXXFXFpX-5'         "AS-M127"
3'-XpFpXFXFXFXFXFXFXFXFXFFXXXpX-5'          "AS-M128"
3'-XpFpXFXFXFXFXFXFXFXFXFFFFFpF-5'          "AS-M129"
3'-XpFpXFXFXFXFXFXFXFXFXFXFXFpX-5'          "AS-M130"
3'-XpFpXFXFXFXFXFXFXFXFXFXFXFpX-5'          "AS-M131"
3'-XpFpXFXFXFXFXFXFXFXFXFXXXXpX-5'          "AS-M132"
3'-XpFpXFXFXFXFXFXFXFXFXFXXXXpX-5'          "AS-M133"
3'-XpFpXFXFXFXFXFXFXFXFXFFFFpF-5'           "AS-M134"
3'-XXXXXXXXXXXXXXXXXXXXXXXXXX-5'            "AS-M135"
3'-XXXXXXXXXXXXXXXXXXXXXXXXXX-5'            "AS-M136"
3'-XXXXXXXXXXXXXXXXXXXXXXXXXX-5'            "AS-M137"
3'-XXXFXFXFXXXXXFXFXFXFXXXXXX-5'            "AS-M138"
3'-XXXFXFXFXXXXXXXXXXFXXXXXX-5'             "AS-M139"
3'-XpXXFXFXFXXXXXFXFFFFXXXXXpX-5'           "AS-M140"
3'-XpXXFXFXFFXXXXFFXFXFFFXXXXXpX-5'         "AS-M141"
3'-XpXXFXFXFXFXFXFXFFFXXXXXpX-5'            "AS-M142"
3'-XpXXFXFXFFFFFFXFXFFFXXXXXpX-5'           "AS-M143"
3'-XpXXFXFXFXFXFXFXFXFpXpFpFpXXXXXpX-5'     "AS-M144"
3'-XXXXXXXXXXXXXXXFXXXXXXXXXX-5'            "AS-M145"
3'-XXXXXXXXXXXXXXFXXXXXXXXXX-5'             "AS-M146"
3'-XXXXXFXXXXXXXXXXXXXXXXXXXX-5'            "AS-M147"
3'-XXXXXXXXXFXXXXXXXXXXXXXX-5'              "AS-M148"
3'-XXXXXXXXXXFXXXXXXXXXXXXXX-5'             "AS-M149"
3'-XXXXXXXXXXFXFXXXXXXXXXXXX-5'             "AS-M150"
3'-XXXXXXXXXXFXXFXXXXXXXXXXX-5'             "AS-M151"
3'-XXXXXXXXXFXXXXXXXXXXXXXX-5'              "AS-M152"
3'-XXXXXXXFXXXXXXXXXXXXXXXX-5'              "AS-M153"
3'-XXXXXXFXXXXXXXXXXXXXXXXX-5'              "AS-M154"
3'-XXXXXXFXXXXXXXXXXXXXXXXXX-5'             "AS-M155"
3'-XpXXXXXXXXXXXXXXXXXXXXXXXpX-5'           "AS-M156"
3'-XpXXXXXXXXXXXXXXXXXXXXXXXpX-5'           "AS-M157"
3'-XpXXFXFFFFXXXXXXFXFXFFXXXXXpX-5'         "AS-M158"
3'-XpXXFXFFFFFFFFXXFXXFFXXXXXpX-5'          "AS-M159"
3'-XpXXFXXXXXXXXFXFXXFFXXXXXpX-5'           "AS-M160"
3'-XpXXFXXXFXFXFXFXFXXFFXXXXXpX-5'          "AS-M161"
```

-continued

```
3'-XXXXXXXXFXFXFXXXXXXXXXXXXXXX-5'       "AS-M162"
3'-XXXXXXXXXXXXXXXXXXXXXXXXXXXX-5'       "AS-M163"
3'-XXXXXXXXDXXXXXXXXXXXXXXXXXX-5'        "AS-M164"

3'-XpXXXXXXXXXXXXXXXXXXXXXXXXpX-5'       "AS-M120*"
3'-XpXXXXXXXXXXXXXXXXXXXXXXXXpX-5'       "AS-M121*"
3'-XpXXXXXXXXXXXXXXXXXXXXXXXXpX-5'       "AS-M122*"
3'-XpXXXXXXXXXXXXXXXXXXXXXXXXpX-5'       "AS-M123*"
3'-XpXXXXXXXXXXXXXXXXXXXXXXXXpX-5'       "AS-M124*"
3'-XpXXXXXXXXXXXXXXXXXXXXXXXXpX-5'       "AS-M125*"
3'-XpFpXFXFXXXXXFXFXFXXXXFXFpX-5'        "AS-M126*"
3'-XpFpXFXFXFXXXXXFXFXFXXXXFXFpX-5'      "AS-M127*"
3'-XpFpXFXFXFXFXFXFXFXFXFFXXXpX-5'       "AS-M128*"
3'-XpFpXFXFXFXFXFXFXFXFXFFFFFpF-5'       "AS-M129*"
3'-XpFpXFXFXFXFXFXFXFXFXXXXFpX-5'        "AS-M130*"
3'-XpFpXFXFXFXFXFXFXFXFXFXFXFpX-5'       "AS-M131*"
3'-XpFpXFXFXFXFXFXFXFXFXFXXXXpX-5'       "AS-M132*"
3'-XpFpXFXFXFXFXFXFXFXFXFXXXXpX-5'       "AS-M133*"
3'-XpFpXFXFXFXFXFXFXFXFXFXFFFpF-5'       "AS-M134*"
3'-XXXXXXXXXXXXXXXXXXXXXXXXXXXX-5'       "AS-M135*"
3'-XXXXXXXXXXXXXXXXXXXXXXXXXXXX-5'       "AS-M136*"
3'-XXXXXXXXXXXXXXXXXXXXXXXXXXXX-5'       "AS-M137*"
3'-XXXFXFXFXXXXXXFXFXFXFXXXXXXX-5'       "AS-M138*"
3'-XXXFXFXFFXXXXXXXXFXXXXXXXXX-5'        "AS-M139*"
3'-XpXXFXFXFXXXXFXFXFFFXXXXXXpX-5'       "AS-M140*"
3'-XpXXFXFXFFXXXFFXFFFFXXXXXpX-5'        "AS-M141*"
3'-XpXXFXFXFXFXFXFXFFFXXXXXXpX-5'        "AS-M142*"
3'-XpXXFXFXFFFFFFFXFXFFFXXXXXpX-5'       "AS-M143*"
3'-XpXXFXFXFXFXFXFXFXFpXpXXXXXXpX-5'     "AS-M144*"
3'-XXXXXXXXXXXXXXXXFXXXXXXXXXXX-5'       "AS-M145*"
3'-XXXXXXXXXXXXXFXXXXXXXXXXXXX-5'        "AS-M146*"
3'-XXXXXXFXXXXXXXXXXXXXXXXXXXX-5'        "AS-M147*"
3'-XXXXXXXXXXXFXXXXXXXXXXXXXXX-5'        "AS-M148*"
3'-XXXXXXXXXXXXXXXXXXXXXXXXXXX-5'        "AS-M149*"
3'-XXXXXXXXXXXFXFXXXXXXXXXXXXX-5'        "AS-M150*"
3'-XXXXXXXXXXXFXXXFXXXXXXXXXXX-5'        "AS-M151*"
3'-XXXXXXXXXXFXXXFXXXXXXXXXXXX-5'        "AS-M152*"
3'-XXXXXXXXFXXXXXXXXXXXXXXXXXX-5'        "AS-M153*"
3'-XXXXXXXXFXXXXXXXXXXXXXXXXXX-5'        "AS-M154*"
3'-XXXXXXFXXXXXXXXXXXXXXXXXXXX-5'        "AS-M155*"
3'-XpXXXXXXXXXXXXXXXXXXXXXXXXpX-5'       "AS-M156*"
3'-XpXXXXXXXXXXXXXXXXXXXXXXXXpX-5'       "AS-M157*"
3'-XpXXFXFFFFXXXFXXFXXFFXXXXXpX-5'       "AS-M158*"
3'-XpXXFXFFFFFFFFXXFXXFFXXXXXpX-5'       "AS-M159*"
3'-XpXXFXXXFXXXXXFXFXFXXFFXXXXXpX-5'     "AS-M160*"
3'-XpXXFXXXXFXFXFXFXXFFXXXXXpX-5'        "AS-M161*"
3'-XXXXXXXXFXFXFXXXXXXXXXXXXXX-5'        "AS-M162*"
3'-XXXXXXXXXXXXXXXXXXXXXXXXXXXX-5'       "AS-M163*"
3'-XXXXXXXXDXXXXXXXXXXXXXXXXXX-5'        "AS-M164*"

3'-XXXXXXXXXXXXXXXXXXXXXXXXXXXX-5'       "AS-M211"
3'-XXXXXXXXXXXXXXXXXXXXXXXXXXXX-5'       "AS-M212"
3'-XXXXXXXXXXXXXXXXXXXXXXXXXXXX-5'       "AS-M215"
3'-XXXXXXXXXXXXXXXXXXXXXXXXXXXX-5'       "AS-M216"
3'-XXXXXXXXXXXXXXXXXXXXXXXXXXXX-5'       "AS-M217"
3'-XXXXXXXXXXXXXXXXXXXXXXXXXXXX-5'       "AS-M218"
3'-XXXXXXXXXXXXXXXXXXXXXXXXXXXX-5'       "AS-M219"
3'-XXXXXXXXXXXXXXXXXXXXXXXXXXXX-5'       "AS-M220"
3'-XXXXXXXXXXXXXXXXXXXXXXXXXXXX-5'       "AS-M221"
3'-XXXXXXXXXXXXXXXXXXXXXXXXXXXX-5'       "AS-M222"
3'-XXXXXXXXXXXXXXXXXXXXXXXXXXXX-5'       "AS-M223"
3'-XXXXXXXXXXXXXXXXXXXXXXXXXXXX-5'       "AS-M224"
3'-XXXXXXXXXXXXXXXXXXXXXXXXXXXX-5'       "AS-M225"
3'-XXXXXXXXXXXXXXXXXXXXXXXXXXXX-5'       "AS-M226"
3'-XXXXXXXXXXXXXXXXXXXXXXXXXXXX-5'       "AS-M230"
3'-XXXXXXXXXXXXXXXXXXXXXXXXXXXX-5'       "AS-M231"
3'-XXXXXXXXXXXXXXXXXXXXXXXXXXXX-5'       "AS-M232"
3'-XXXXXXXXXXXXXXXXXXXXXXXXXXXX-5'       "AS-M233"
3'-XXXXXXXXXXXXXXXXXXXXXXXXXXXX-5'       "AS-M234"
3'-XXXXXXXXXXXXXXXXXXXXXXXXXXXX-5'       "AS-M235"
3'-XXXXXXXXXXXXXXXXXXXXXXXXXXXX-5'       "AS-M236"
3'-XXXXXXXXXXXXXXXXXXXXXXXXXXXX-5'       "AS-M237"
3'-XXXXXXXXXXXXXXXXXXXXXXXXXXXX-5'       "AS-M238"
3'-XXXXXXXXXXXXXXXXXXXXXXXXXXXX-5'       "AS-M239"
3'-XXXXXXXXXXXXXXXXXXXXXXXXXXXX-5'       "AS-M240"
3'-XXXXXXXXXXXXXXXXXXXXXXXXXXXX-5'       "AS-M241"
3'-XXXXXXXXXXXXXXXXXXXXXXXXXXXX-5'       "AS-M242"
3'-XpXXXXXXXXXXXXXXXXXXXXXXXXpX-5'       "AS-M243"
3'-XpXXXXXXXXXXXXXXXXXXXXXXXXpX-5'       "AS-M244"
3'-XpXXXXXXXXXXXXXXXXXXXXXXXXpX-5'       "AS-M245"
3'-XpXXXXXXXXXXXXXXXXXXXXXXXXpX-5'       "AS-M246"
```

-continued

```
3'-XpXXXXXXXXXXXXXXXXXXXXXXXXXpX-5'    "AS-M247"
3'-XpXXXXXXXXXXXXXXXXXXXXXXXXXpX-5'    "AS-M248"
3'-XpXXXXXXXXXXXXXXXXXXXXXXXXXpX-5'    "AS-M249"
3'-XpXXXXXXXXXXXXXXXXXXXXXXXXXpX-5'    "AS-M250"
3'-XpXXXXXXXXXXXXXXXXXXXXXXXXXpX-5'    "AS-M251"
3'-XpXXXXXXXXXXXXXXXXXXXXXXXXXpX-5'    "AS-M252"
3'-XpXXXXXXXXXXXXXXXXXXXXXXXXXpX-5'    "AS-M253"
3'-XpXXXXXXXXXXXXXXXXXXXXXXXXXpX-5'    "AS-M254"
3'-XpXXXXXXXXXXXXXXXXXXXXXXXXXpX-5'    "AS-M255"

3'-XXXXXXXXXXXXXXXXXXXXXXXXXXX-5'      "AS-M211*"
3'-XXXXXXXXXXXXXXXXXXXXXXXXXXX-5'      "AS-M212*"
3'-XXXXXXXXXXXXXXXXXXXXXXXXXXX-5'      "AS-M215*"
3'-XXXXXXXXXXXXXXXXXXXXXXXXXXX-5'      "AS-M216*"
3'-XXXXXXXXXXXXXXXXXXXXXXXXXXX-5'      "AS-M217*"
3'-XXXXXXXXXXXXXXXXXXXXXXXXXXX-5'      "AS-M218*"
3'-XXXXXXXXXXXXXXXXXXXXXXXXXXX-5'      "AS-M219*"
3'-XXXXXXXXXXXXXXXXXXXXXXXXXXX-5'      "AS-M220*"
3'-XXXXXXXXXXXXXXXXXXXXXXXXXXX-5'      "AS-M221*"
3'-XXXXXXXXXXXXXXXXXXXXXXXXXXX-5'      "AS-M222*"
3'-XXXXXXXXXXXXXXXXXXXXXXXXXXX-5'      "AS-M223*"
3'-XXXXXXXXXXXXXXXXXXXXXXXXXXX-5'      "AS-M224*"
3'-XXXXXXXXXXXXXXXXXXXXXXXXXXX-5'      "AS-M225*"
3'-XXXXXXXXXXXXXXXXXXXXXXXXXXX-5'      "AS-M226*"
3'-XXXXXXXXXXXXXXXXXXXXXXXXXXX-5'      "AS-M230*"
3'-XXXXXXXXXXXXXXXXXXXXXXXXXXX-5'      "AS-M231*"
3'-XXXXXXXXXXXXXXXXXXXXXXXXXXX-5'      "AS-M232*"
3'-XXXXXXXXXXXXXXXXXXXXXXXXXXX-5'      "AS-M233*"
3'-XXXXXXXXXXXXXXXXXXXXXXXXXXX-5'      "AS-M234*"
3'-XXXXXXXXXXXXXXXXXXXXXXXXXXX-5'      "AS-M235*"
3'-XXXXXXXXXXXXXXXXXXXXXXXXXXX-5'      "AS-M236*"
3'-XXXXXXXXXXXXXXXXXXXXXXXXXXX-5'      "AS-M237*"
3'-XXXXXXXXXXXXXXXXXXXXXXXXXXX-5'      "AS-M238*"
3'-XXXXXXXXXXXXXXXXXXXXXXXXXXX-5'      "AS-M239*"
3'-XXXXXXXXXXXXXXXXXXXXXXXXXXX-5'      "AS-M240*"
3'-XXXXXXXXXXXXXXXXXXXXXXXXXXX-5'      "AS-M241*"
3'-XXXXXXXXXXXXXXXXXXXXXXXXXXX-5'      "AS-M242*"
3'-XpXXXXXXXXXXXXXXXXXXXXXXXXXpX-5'    "AS-M243*"
3'-XpXXXXXXXXXXXXXXXXXXXXXXXXXpX-5'    "AS-M244*"
3'-XpXXXXXXXXXXXXXXXXXXXXXXXXXpX-5'    "AS-M245*"
3'-XpXXXXXXXXXXXXXXXXXXXXXXXXXpX-5'    "AS-M246*"
3'-XpXXXXXXXXXXXXXXXXXXXXXXXXXpX-5'    "AS-M247*"
3'-XpXXXXXXXXXXXXXXXXXXXXXXXXXpX-5'    "AS-M248*"
3'-XpXXXXXXXXXXXXXXXXXXXXXXXXXpX-5'    "AS-M249*"
3'-XpXXXXXXXXXXXXXXXXXXXXXXXXXpX-5'    "AS-M250*"
3'-XpXXXXXXXXXXXXXXXXXXXXXXXXXpX-5'    "AS-M251*"
3'-XpXXXXXXXXXXXXXXXXXXXXXXXXXpX-5'    "AS-M252*"
3'-XpXXXXXXXXXXXXXXXXXXXXXXXXXpX-5'    "AS-M253*"
3'-XpXXXXXXXXXXXXXXXXXXXXXXXXXpX-5'    "AS-M254*"
3'-XpXXXXXXXXXXXXXXXXXXXXXXXXXpX-5'    "AS-M255*"
``` where "X"=RNA, "X"=2'-O-methyl RNA, "D"=DNA, "F"=2'-Fluoro NA and "p"=Phosphorothioate linkage.

In certain additional embodiments, the antisense strand of selected dsRNAs of the invention are extended, optionally at the 5' end, with an exemplary 5' extension of base "AS-M8", "AS-M17" and "AS-M48" modification patterns respectively represented as follows:

"AS-M8, extended"
(SEQ ID NO: 3478)
3'-XXXXXXXXXXXXXXXXXXXXXXXXXXXXXUAGCUAUCGT-5'

"AS-M17, extended"
(SEQ ID NO: 3478)
3'-XXXXXXXXXXXXXXXXXXXXXXXXXXXXXUAGCUAUCGT-5'

-continued

"AS-M48, extended"
(SEQ ID NO: 3478)
3'-XXXXXXXXXXXXXXXXXXXXXXXXXXXXXUAGCUAUCGT-5' where "X"=RNA; "X"=2'-O-methyl RNA; "F"=2'-Fluoro NA and "A" in bold, italics indicates a 2'-Fluoro-adenine residue.

In certain embodiments, the sense strand of a DsiRNA of the invention is modified—specific exemplary forms of sense strand modifications are shown below, and it is contemplated that such modified sense strands can be substituted for the sense strand of any of the DsiRNAs shown above to generate a DsiRNA comprising a below-depicted sense strand that anneals with an above-depicted antisense strand. Exemplary sense strand modification patterns include:

```
5'-XXXXXXXXXXXXXXXXXXXXXXXDD-3'    "SM1"
5'-XXXXXXXXXXXXXXXXXXXXXXXDD-3'    "SM2"
5'-XXXXXXXXXXXXXXXXXXXXXXXDD-3'    "SM3"
5'-XXXXXXXXXXXXXXXXXXXXXXXDD-3'    "SM4"
5'-XXXXXXXXXXXXXXXXXXXXXXXDD-3'    "SM5"
5'-XXXXXXXXXXXXXXXXXXXXXXXDD-3'    "SM6"
```

-continued

| Sequence | Name |
|---|---|
| 5'-XXXXXXXXXXXXXXXXXXXXXXXXDD-3' | "SM7" |
| 5'-XXXXXXXXXXXXXXXXXXXXXXXXDD-3' | "SM8" |
| 5'-XXXXXXXXXXXXXXXXXXXXXXXXDD-3' | "SM9" |
| 5'-XXXXXXXXXXXXXXXXXXXXXXXXDD-3' | "SM10" |
| 5'-XXXXXXXXXXXXXXXXXXXXXXXXDD-3' | "SM11" |
| 5'-XXXXXXXXXXXXXXXXXXXXXXXXDD-3' | "SM12" |
| 5'-XXXXXXXXXXXXXXXXXXXXXXXXDD-3' | "SM13" |
| 5'-XXXXXXXXXXXXXXXXXXXXXXXXDD-3' | "SM14" |
| 5'-XXXXXXXXXXXXXXXXXXXXXXXXDD-3' | "SM15" |
| 5'-XXXXXXXXXXXXXXXXXXXXXXXXDD-3' | "SM16" |
| 5'-XXXXXXXXXXXXXXXXXXXXXXXXDD-3' | "SM17" |
| 5'-XXXXXXXXXXXXXXXXXXXXXXXXDD-3' | "SM18" |
| 5'-XXXXXXXXXXXXXXXXXXXXXXXXDD-3' | "SM19" |
| 5'-XXXXXXXXXXXXXXXXXXXXXXXXDD-3' | "SM20" |
| 5'-XXXXXXXXXXXXXXXXXXXXXXXXDD-3' | "SM21" |
| 5'-XXXXXXXXXXXXXXXXXXXXXXXXDD-3' | "SM23" |
| 5'-XXXXXXXXXXXXXXXXXXXXXXXXDD-3' | "SM24" |
| 5'-XXXXXXXXXXXXXXXXXXXXXXXXDD-3' | "SM25" |
| 5'-XXXXXXXXXXXXXXXXXXXXXXXXDD-3' | "SM30" |
| 5'-XXXXXXXXXXXXXXXXXXXXXXXXDD-3' | "SM31" |
| 5'-XXXXXXXXXXXXXXXXXXXXXXXXDD-3' | "SM32" |
| 5'-XXXXXXXXXXXXXXXXXXXXXXXXDD-3' | "SM33" |
| 5'-XXXXXXXXXXXXXXXXXXXXXXXXDD-3' | "SM34" |
| 5'-XXXXXXXXXXXXXXXXXXXXXXXXDD-3' | "SM35" |
| 5'-XXXXXXXXXXXXXXXXXXXXXXXXDD-3' | "SM36" |
| 5'-XXXXXXXXXXXXXXXXXXXXXXXXDD-3' | "SM37" |
| 5'-XXXXXXXXXXXXXXXXXXXXXXXXDD-3' | "SM38" |
| 5'-XXXXXXXXXXXXXXXXXXXXXXXXDD-3' | "SM39" |
| 5'-XXXXXXXXXXXXXXXXXXXXXXXXDD-3' | "SM40" |
| 5'-XXXXXXXXXXXXXXXXXXXXXXXXDD-3' | "SM41" |
| 5'-XXXXXXXXXXXXXXXXXXXXXXXXDD-3' | "SM42" |
| 5'-XXXXXXXXXXXXXXXXXXXXXXXXDD-3' | "SM43" |
| 5'-XXXXXXXXXXXXXXXXXXXXXXXXDD-3' | "SM44" |
| 5'-XXXXXXXXXXXXXXXXXXXXXXXXDD-3' | "SM45", "SM47" |
| 5'-XXXXXXXXXXXXXXXXXXXXXXXXDD-3' | "SM46" |
| 5'-XXXXXXXXXXXXXXXXXXXXXXXXDD-3' | "SM48" |
| 5'-XXXXXXXXXXXXXXXXXXXXXXXXDD-3' | "SM49" |
| 5'-XXXXXXXXXXXXXXXXXXXXXXXXDD-3' | "SM50" |
| 5'-XXXXXXXXXXXXXXXXXXXXXXXXDD-3' | "SM51" |
| 5'-XXXXXXXXXXXXXXXXXXXXXXXXDD-3' | "SM52" |
| 5'-XXXXXXXXXXXXXXXXXXXXXXXXDD-3' | "SM53" |
| 5'-XXXXXXXXXXXXXXXXXXXXXXXXDD-3' | "SM54" |
| 5'-XXXXXXXXXXXXXXXXXXXXXXXXDD-3' | "SM55" |
| 5'-XXXXXXXXXXXXXXXXXXXXXXXXDD-3' | "SM56" |
| 5'-XXXXXXXXXXXXXXXXXXXXXXXXDD-3' | "SM57" |
| 5'-XXXXXXXXXXXXXXXXXXXXXXXXDD-3' | "SM58" |
| 5'-XXXXXXXXXXXXXXXXXXXXXXXXDD-3' | "SM59" |
| 5'-XXXXXXXXXXXXXXXXXXXXXXXXDD-3' | "SM60" |
| 5'-XXXXXXXXXXXXXXXXXXXXXXXXDD-3' | "SM61" |
| 5'-XXXXXXXXXXXXXXXXXXXXXXXXDD-3' | "SM62" |
| 5'-XXXXXXXXXXXXXXXXXXXXXXXXDD-3' | "SM63" |
| 5'-XXXXXXXXXXXXXXXXXXXXXXXXDD-3' | "SM64" |
| 5'-XXXXXXXXXXXXXXXXXXXXXXXXDD-3' | "SM65" |
| 5'-XXXXXXXXXXXXXXXXXXXXXXXXpDpD-3' | "SM66" |
| 5'-XpXXXXXXXXXXXXXXXXXXXXXXXDD-3' | "SM67" |
| 5'-XpXXXXXXXXXXXXXXXXXXXXXXXpDpD-3' | "SM68" |
| 5'-DXXXXXXXXXXXXXXXXXXXXXXXXDD-3' | "SM69" |
| 5'-DpXXXXXXXXXXXXXXXXXXXXXXXXpDpD-3' | "SM70" |
| 5'-DXDXXXXXXXXXXXXXXXXXXXXXXDD-3' | "SM71" |
| 5'-DpXDXXXXXXXXXXXXXXXXXXXXXXDD-3' | "SM72" |
| 5'-XXDXXXXXXXXXXDXXXXXXXXXXXDD-3' | "SM73" |
| 5'-XpXDXXXXXXXXXXDXXXXXXXXXXXDD-3' | "SM74" |
| 5'-DXDXXXXXXXXXXDXXXXXDXXXXXDD-3' | "SM75" |
| 5'-DpXDXXXXXXXXXXDXXXXXDXXXXXDD-3' | "SM76" |
| 5'-XpXpXXXXXXXXXXXXXXXXXXXXXXDD-3' | "SM77" |
| 5'-XpXpXXXXXXXXXXXXXXXXXXXXXXpDpD-3' | "SM78" |
| 5'-DpXpDXXXXXXXXXXXXXXXXXXXXXDD-3' | "SM79" |
| 5'-XpXpDXXXXXXXXXXDXXXXXXXXXXDD-3' | "SM80" |
| 5'-DXDXXXDXXXXXXDXXXXXDXXXXDD-3' | "SM81" |
| 5'-DpXDXXXXDXXXXXDXXXXXDXXXXpDpD-3' | "SM82" |
| 5' C3 spacer-XXXXXXXXXXXXXXXXXXXXXXXXDD-3' | "SM83" |
| 5' C3 spacer-XXDXXXXXXXXXXDXXXXXXXXXXXDD-3' | "SM84" |
| 5' C3 spacer-XXXXXXXXXXXXXXXXXXXXXXXXpDpD-3' | "SM85" |
| 5'-XXXXXXXXXXXXXXXXXXXXXXXXXpDpD-3' | "SM86" |
| 5'-XpXXXXXXXXXXXXXXXXXXXXXXDD-3' | "SM87" |
| 5'-XpXXXXXXXXXXXXXXXXXXXXXXpDpD-3' | "SM88" |
| 5'-DXXXXXXXXXXXXXXXXXXXXXXXXDD-3' | "SM89" |
| 5'-DpXXXXXXXXXXXXXXXXXXXXXXXXpDpD-3' | "SM90" |
| 5'-DXDXXXXXXXXXXXXXXXXXXXXXXXDD-3' | "SM91" |
| 5'-DpXDXXXXXXXXXXXXXXXXXXXXXXDD-3' | "SM92" |
| 5'-XXDXXXXXXXXXXDXXXXXXXXXXXDD-3' | "SM93" |

-continued

```
5'-XpXDXXXXXXXXXXDXXXXXXXXXXDD-3'           "SM94"
5'-DXDXXXXXXXXXXDXXXXXDXXXXDD-3'            "SM95"
5'-DpXDXXXXXXXXXXDXXXXXDXXXXDD-3'           "SM96"
5'-XpXpXXXXXXXXXXXXXXXXXXXXXDD-3'           "SM97"
5'-XpXpXXXXXXXXXXXXXXXXXXXXpDpD-3'          "SM98"
5'-DpXpDXXXXXXXXXXXXXXXXXXXXDD-3'           "SM99"
5'-XpXpDXXXXXXXXXDXXXXXXXXXXDD-3'           "SM100"
5'-DXDXXXXXXXXXXDXDXXXDDXXDDD-3'            "SM101"
5'-DpXDXXXXDXXXXXDXXXXXDXXXXpDpD-3'         "SM102"
5' C3 spacer-XXXXXXXXXXXXXXXXXXXXXXXXDD-3'  "SM103"
5' C3 spacer-XXDXXXXXXXXXDXXXXXXXXXXDD-3'   "SM104"
5' C3 spacer-XXXXXXXXXXXXXXXXXXXXXXXpDpD-3' "SM105"
5'-XXXXXXXXXXXXXXXXXXXXXXXXDD-3'            "SM106"
5'-XXXXXXXXXXXXXXXXXXXXXXXXDD-3'            "SM107"
5'-XXXXXXXXXXXXXXXXXXXXXXXXDD-3'            "SM108"
5'-XFXXXXXXXXXXXXXXXFXXXXXDD-3'             "SM110"
5'-XXXFXFXXXXXXXFXXXXXXXXXDD-3'             "SM111"
5'-XFXFXFXXXXFXFXFXXXXXXDD-3'               "SM112"
5'-XpFXFXFXFXXXXFXFXFXXXXXXpDpD-3'          "SM113"
5'-XFXXXXXXXXXXXXXXXXXXXXXXDD-3'            "SM114"
5'-XXXXFFXFXXXFXPXXXXXXXXXDD-3'             "SM115"
5'-XFXFXXXXXXXXXXFXXXXXXXXDD-3'             "SM116"
5'-XFXFFFXFXXXXFXPXFFFXXXXXDD-3'            "SM117"
5'-XFXFXFXFXXXXFXPXFXPXXXXXDD-3'            "SM118"
5'-XpFXFXFXFXXXXFXPXFXPXXXXXXpDpD-3'        "SM119"
5'-XXXXXXXXXXXXXXXXXXXXXXXXDD-3'            "SM250"
5'-XXXXXXXXXXXXXXXXXXXXXXXXDD-3'            "SM251"
5'-XXXXXXXXXXXXXXXXXXXXXXXXDD-3'            "SM252"

5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'
5'-XXXXXXXXXXXXXXXXXXXXXXXXX-3'  "SM22"
5'-XXXXXXXXXXXXXXXXXXXXXXXXX-3
5'-XXXXXXXXXXXXXXXXXXXXXXXXX-3'
5'-XXXXXXXXXXXXXXXXXXXXXXXXX-3'
```

-continued

```
5'-XpXXXXXXXXXXXXXXXXXXXXXXXDpD-3'           "SM120"
5'-FpXFXFXFXFXFXFXFXFXFXXXDpD-3'             "SM121"
5'-XpXXXXXXXXXXXXXXXXXXXXXXXDpD-3'           "SM122"
5'-XpXXXXXXXXXXXXXXXXXXXXXXXDpD-3'           "SM123"
5'-FpXFXXXFXXXXXXXXXXXXXXpDpD-3'             "SM124"
5'-FpXFXXXFXXXXFXXXXXXXXXpDpD-3'             "SM125"
5'-FpXFXXXFXFFFXFXXXXXXXXpDpD-3'             "SM126"
5'-FpXFXXXFXFFFXFXXXFFXXXpDpD-3'             "SM127"
5'-FpXFXXXFXFFFXFXXXFFXXFpDpD-3'             "SM128"
5'-FpXFXXXFFFFXFXXXFFFFFpDpD-3'              "SM129"
5'-FpXFXFXFXFXFXFXFXFXFXFpDpD-3'             "SM130"

5'-XpXXXXXXXXXXXXXXXXXXXXXXXpX-3'
5'-FpXFXFXFXFXFXFXFXFXFXXXpX-3'
5'-XpXXXXXXXXXXXXXXXXXXXXXXXpX-3'
5'-XpXXXXXXXXXXXXXXXXXXXXXXXpX-3'
5'-FpXFXXXFXXXXXXXXXXXXXXXpXpX-3'
5'-FpXFXXXFXXXXXFXXXXXXXXpXpX-3'
5'-FpXFXXXFXFFFXFXXXXXXXXpXpX-3'
5'-FpXFXXXFXFFFXFXXXFFXXXpXpX-3'
5'-FpXFXXXFXFFFXFXXXFFXXFpXpX-3'
5'-FpXFXXXFFFFXFXXXFFFFFpXpX-3'
5'-FpXFXFXFXFXFXFXFXFXFXFpXpX-3'

5'-XpXXXXXXXXXXXXXXXXXXXXXXXpDpD-3'          "SM133"
5'-XpXXXXXXXXXXXXXXXXXXXXXXXpDpD-3'          "SM134"
5'-XpXXXXXXXXXXXXXXXXXXXXXXXpDpD-3'          "SM135"
5'-XpXXXXXXXXXXXXXXXXXXXXXXXpDpD-3'          "SM136"
5'-XpXXXXXXXXXXXXXXXXXXXXXXXpDpD-3'          "SM137"
5'-XpXXXXXXXXXXXXXXXXXXXXXXXpDpD-3'          "SM138"

5'-XpXXXXXXXXXXXXXXXXXXXXXXXpXpX-3'
5'-XpXXXXXXXXXXXXXXXXXXXXXXXpXpX-3'
5'-XpXXXXXXXXXXXXXXXXXXXXXXXpXpX-3'
5'-XpXXXXXXXXXXXXXXXXXXXXXXXpXpX-3'
5'-XpXXXXXXXXXXXXXXXXXXXXXXXpXpX-3'
5'-XpXXXXXXXXXXXXXXXXXXXXXXXpXpX-3'

5'-XpXXXXXXXXXXXXXXXXXXXXXXXDpD-3'           "SM140"
5'-XpXXXXXXXXXXXXXXXXXXXXXXXDpD-3'           "SM141"
5'-XpXXXXXXXXXXXXXXXXXXXXXXXDpD-3'           "SM142"
5'-FpXFXFXFXFXFXFXFXFXXXFDpD-3'              "SM143"
5'-FpXFXFXFXFXFXFXFXFFFFDpD-3'               "SM144"
5'-FpXFXFXFXFXFXFXFXFXXXXDpD-3'              "SM145"
5'-FpXFXFXFXFXFXFXFXFXFXFDpD-3'              "SM146"
5'-FXFXXXFXFFFXFXFXXXXXXXXDD-3'              "SM147"
5'-FXFXXXFXFFFXFXXXFFXXDD-3'                 "SM148"
5'-FXFXXXFXFFFXFXXXFFXXFDD-3'                "SM149"
5'-FXFXXXFXFFFXFXXXFFFFFDD-3'                "SM150"
5'-FpXFXFXFXFFFXFXFXFFXXFDpD-3'              "SM151"
5'-FpXFXFXXFFFFFXXXFXFXXXXDpD-3'             "SM152"
5'-FpXFXXXFFFFFXXXFXXFXXXDpD-3'              "SM153"
5'-ab-XXFXXFFFXXFFXXXFFFFXpXXXDD-3'          "SM154" (ab = abasic for F7
                                             stabilization at 5' end)
5'-XpXXXXXXXXXXXXXXXXXXXXXXXpX-3'            "SM155"
5'-XpXXXXXXXXXXXXXXXXXXXXXXXpX-3'            "SM156"
5'-FpXFXXXFFFFFFFXXXFXXFXXXFXpX-3'           "SM157"
5'-XpXFXFXXFFFFXFXFXFXXXXXXpX-3'             "SM158"
5'-FpXFXXXFXFFXFXXXXFXXXXpX-3'               "SM159"
5'-FpXFXFXFXFFFXFXFXFXFXXXXXX-3'             "SM160"

5'-XpXXXXXXXXXXXXXXXXXXXXXXXpX-3'
5'-XpXXXXXXXXXXXXXXXXXXXXXXXpX-3'
5'-XpXXXXXXXXXXXXXXXXXXXXXXXpX-3'
5'-FpXFXFXFXFXFXFXFXFXXXFXpX-3'
5'-FpXFXFXFXFXFXFXFXFFFFFXpX-3'
5'-FpXFXFXFXFXFXFXFXFXXXXXpX-3'
5'-FpXFXFXFXFXFXFXFXFXFXFpX-3'
5'-FXFXXXFXFFFXFXXXXXXXXX-3'
5'-FXFXXXFXFFFXFXXXFFXXXX-3'
5'-FXFXXXFXFFFXFXXXFFXFXX-3'
5'-FXFXXXFXFFFXFXXXFFFFXX-3'
5'-FpXFXFXFFFFXFXFXFFXXFXpX-3'
5'-FpXFXFXFXFXFXFXFXFXXXXXpX-3'
5'-FpXFXXXFFFFFXXXFXXFXXXXpX-3'
5'-ab-XXFXXFFFXXFFXXXFFFFXpXXXXX-3'          (ab = abasic for F7
                                             stabilization at 5' end)
5'-XpXXXXXXXXXXXXXXXXXXXXXXXpX-3'
5'-XpXXXXXXXXXXXXXXXXXXXXXXXpX-3'
5'-FpXFXXXFFFFFFFFXXXFXXFXpX-3'
5'-XpXFXFXXXFFFFXFXFXFXXFXXXXpX-3'
```

-continued

```
5'-FpXFXXXFXFFXFXXXFXXXXpX-3'
5'-FpXFXFXFXFFFXFXFXFXXXXXX-3'

5'-XXXXXXXXXXXXXXXXXXXXXXDD-3'      "SM253"
5'-XXXXXXXXXXXXXXXXXXXXXXDD-3'      "SM255"
5'-XXXXXXXXXXXXXXXXXXXXXXDD-3'      "SM256"
5'-XXXXXXXXXXXXXXXXXXXXXXDD-3'      "SM257"
5'-XXXXXXXXXXXXXXXXXXXXXXDD-3'      "SM258"
5'-XXXXXXXXXXXXXXXXXXXXXXDD-3'      "SM259"
5'-XXXXXXXXXXXXXXXXXXXXXXDD-3'      "SM260"
5'-XXXXXXXXXXXXXXXXXXXXXXDD-3'      "SM261"
5'-XXXXXXXXXXXXXXXXXXXXXXDD-3'      "SM262"
5'-XXXXXXXXXXXXXXXXXXXXXXDD-3'      "SM263"
5'-XXXXXXXXXXXXXXXXXXXXXXDD-3'      "SM264"
5'-XXXXXXXXXXXXXXXXXXXXXXDD-3'      "SM265"
5'-XXXXXXXXXXXXXXXXXXXXXXDD-3'      "SM266"
5'-XXXXXXXXXXXXXXXXXXXXXXDD-3'      "SM267"
5'-XXXXXXXXXXXXXXXXXXXXXXDD-3'      "SM268"
5'-XXXXXXXXXXXXXXXXXXXXXXDD-3'      "SM269"
5'-XXXXXXXXXXXXXXXXXXXXXXDD-3'      "SM270"
5'-XXXXXXXXXXXXXXXXXXXXXXDD-3'      "SM271"
5'-XXXXXXXXXXXXXXXXXXXXXXDD-3'      "SM275"
5'-XXXXXXXXXXXXXXXXXXXXXXDD-3'      "SM276"
5'-XXXXXXXXXXXXXXXXXXXXXXDD-3'      "SM277"
5'-XXXXXXXXXXXXXXXXXXXXXXDD-3'      "SM278"
5'-XXXXXXXXXXXXXXXXXXXXXXDD-3'      "SM279"
5'-XXXXXXXXXXXXXXXXXXXXXXDD-3'      "SM280"
5'-XXXXXXXXXXXXXXXXXXXXXXDD-3'      "SM281"
5'-XXXXXXXXXXXXXXXXXXXXXXDD-3'      "SM282"
5'-XXXXXXXXXXXXXXXXXXXXXXDD-3'      "SM283"
5'-XXXXXXXXXXXXXXXXXXXXXXDD-3'      "SM284"
5'-XXXXXXXXXXXXXXXXXXXXXXDD-3'      "SM285"
5'-XXXXXXXXXXXXXXXXXXXXXXDD-3'      "SM286"
5'-XXXXXXXXXXXXXXXXXXXXXXDD-3'      "SM287"
5'-XXXXXXXXXXXXXXXXXXXXXXDD-3'      "SM288"
5'-XXXXXXXXXXXXXXXXXXXXXXDD-3'      "SM289"

5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'

5'-XXXXXXXXXXXXXXXXXXXXXXXXDD-3'    "SM300"
5'-XpXXXXXXXXXXXXXXXXXXXXXXDpD-3'   "SM301"
5'-XpXXXXXXXXXXXXXXXXXXXXXXDpD-3'   "SM302"
5'-XpXXXXXXXXXXXXXXXXXXXXXXDpD-3'   "SM303"
5'-XpXXXXXXXXXXXXXXXXXXXXXXDpD-3'   "SM304"
5'-XpXXXXXXXXXXXXXXXXXXXXXXDpD-3'   "SM305"
5'-XpXXXXXXXXXXXXXXXXXXXXXXDpD-3'   "SM306"
5'-XpXXXXXXXXXXXXXXXXXXXXXXDpD-3'   "SM307"
5'-XpXXXXXXXXXXXXXXXXXXXXXXDpD-3'   "SM308"
5'-XpXXXXXXXXXXXXXXXXXXXXXXDpD-3'   "SM309"
```

```
                                   -continued
5'-XpXXXXXXXXXXXXXXXXXXXXXXXXDpD-3'          "SM310"

5'-XXXXXXXXXXXXXXXXXXXXXXXXXXX-3'
5'-XpXXXXXXXXXXXXXXXXXXXXXXXXpX-3'
5'-XpXXXXXXXXXXXXXXXXXXXXXXXXpX-3'
5'-XpXXXXXXXXXXXXXXXXXXXXXXXXpX-3'
5'-XpXXXXXXXXXXXXXXXXXXXXXXXXpX-3'
5'-XpXXXXXXXXXXXXXXXXXXXXXXXXpX-3'
5'-XpXXXXXXXXXXXXXXXXXXXXXXXXpX-3'
5'-XpXXXXXXXXXXXXXXXXXXXXXXXXpX-3'
5'-XpXXXXXXXXXXXXXXXXXXXXXXXXpX-3'
5'-XpXXXXXXXXXXXXXXXXXXXXXXXXpX-3'
5'-XpXXXXXXXXXXXXXXXXXXXXXXXXpX-3'
``` where "X"=RNA, "$\underline{X}$"=2'-O-methyl RNA, "D"=DNA, "F"=2'-Fluoro NA and "p"=Phosphorothioate linkage.

The above modification patterns can also be incorporated into, e.g., the extended DsiRNA structures and mismatch and/or frayed DsiRNA structures described below.

In another embodiment, the DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary 27 mer DsiRNA agent with two terminal mismatched residues is shown:

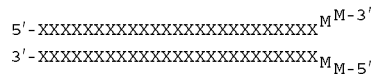

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand is the sense strand, and the bottom strand is the antisense strand. Alternatively, the bottom strand is the sense strand and the top strand is the antisense strand.

In certain additional embodiments, the present invention provides compositions for RNA interference (RNAi) that possess one or more base paired deoxyribonucleotides within a region of a double stranded ribonucleic acid (dsRNA) that is positioned 3' of a projected sense strand Dicer cleavage site and correspondingly 5' of a projected antisense strand Dicer cleavage site. The compositions of the invention comprise a dsRNA which is a precursor molecule, i.e., the dsRNA of the present invention is processed in vivo to produce an active small interfering nucleic acid (siRNA). The dsRNA is processed by Dicer to an active siRNA which is incorporated into RISC.

In certain embodiments, the DsiRNA agents of the invention can have the following exemplary structures (noting that any of the following exemplary structures can be combined, e.g., with the bottom strand modification patterns of the above-described structures—in one specific example, the bottom strand modification pattern shown in any of the above structures is applied to the 27 most 3' residues of the bottom strand of any of the following structures; in another specific example, the bottom strand modification pattern shown in any of the above structures upon the 23 most 3' residues of the bottom strand is applied to the 23 most 3' residues of the bottom strand of any of the following structures):

In one such embodiment, the DsiRNA comprises the following (an exemplary "right-extended", "DNA extended" DsiRNA):

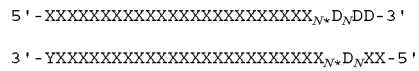

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

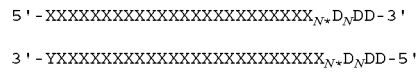

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

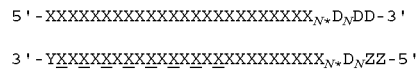

wherein "X"=RNA, "$\underline{X}$"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

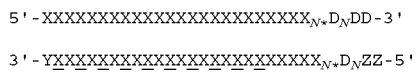

wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

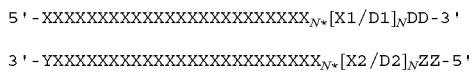

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alter-natively, the bottom strand is the sense strand and the top strand is the antisense strand, with 2'-O-methyl RNA monomers located at alternating residues along the top strand, rather than the bottom strand presently depicted in the above schematic.

In the structures depicted herein, the 5' end of either the sense strand or antisense strand can optionally comprise a phosphate group.

In another embodiment, a DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

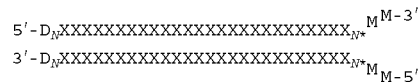

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-15 or, optionally, 1-8. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In one embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. An exemplary structure for such a molecule is shown:

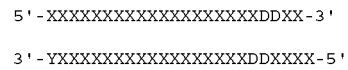

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand. The above structure is modeled to force Dicer to cleave a minimum of a 21 mer duplex as its primary post-processing form. In embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In one embodiment, the DsiRNA comprises the following (an exemplary "left-extended", "DNA extended" DsiRNA):

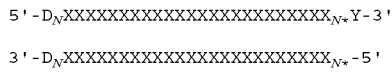

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

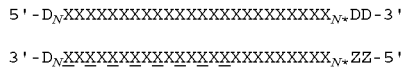

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

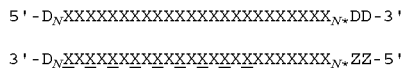

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

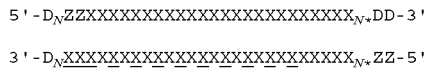

wherein "X"=RNA, "X"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

wherein "X"=RNA, "X"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

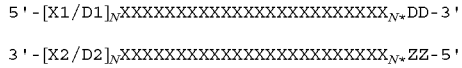

wherein "X"=RNA, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In a related embodiment, the DsiRNA comprises:

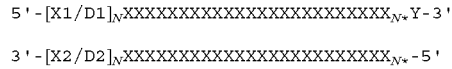

wherein "X"=RNA, "D"=DNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

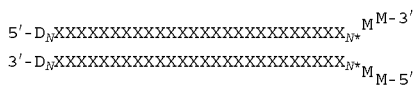

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-8 or 1-10. "N*"=0 to 15 or more, but is optionally 0, 1, 2, 3, 4, 5 or 6. Any of the residues of such agents can optionally be 2'-O-methyl RNA monomers— alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA: DNA extension patterns paralleling those shown above for asymmetric/overhang agents can also be incorporated into such "blunt/frayed" agents.

In another embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. Exemplary structures for such a molecule are shown:

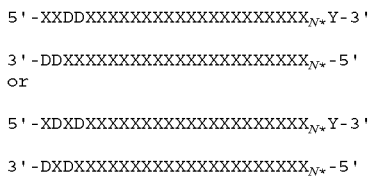

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In any of the above embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In certain embodiments, the "D" residues of the above structures include at least one PS-DNA or PS-RNA. Optionally, the "D" residues of the above structures include at least one modified nucleotide that inhibits Dicer cleavage.

While the above-described "DNA-extended" DsiRNA agents can be categorized as either "left extended" or "right extended", DsiRNA agents comprising both left- and right-extended DNA-containing sequences within a single agent (e.g., both flanks surrounding a core dsRNA structure are dsDNA extensions) can also be generated and used in similar manner to those described herein for "right-extended" and "left-extended" agents.

In some embodiments, the DsiRNA of the instant invention further comprises a linking moiety or domain that joins the sense and antisense strands of a DNA:DNA-extended DsiRNA agent. Optionally, such a linking moiety domain joins the 3' end of the sense strand and the 5' end of the antisense strand. The linking moiety may be a chemical (non-nucleotide) linker, such as an oligomethylenediol linker, oligoethylene glycol linker, or other art-recognized linker moiety. Alternatively, the linker can be a nucleotide linker, optionally including an extended loop and/or tetraloop.

In one embodiment, the DsiRNA agent has an asymmetric structure, with the sense strand having a 25-base pair length, and the antisense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxynucleotides at the 3' end of the sense strand.

In another embodiment, the DsiRNA agent has an asymmetric structure, with the antisense strand having a 25-base pair length, and the sense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxyribonucleotides at the 3' end of the antisense strand.

Exemplary transthyretin targeting DsiRNA agents of the invention, and their associated transthyretin target sequences, include the following, presented in the below series of tables:

Table Number:
(2) Selected Human Anti-transthyretin DsiRNA Agents (Asymmetrics);
(3) Selected Human Anti-transthyretin DsiRNAs, Unmodified Duplexes (Asymmetrics);
(4) DsiRNA Target Sequences (21 mers) in Transthyretin mRNA;
(5) Selected Human Anti-Transthyretin "Blunt/Blunt" DsiRNAs; and
(6) DsiRNA Component 19 Nucleotide Target Sequences in Transthyretin mRNA

TABLE 2

Selected Human Anti-transthyretin DsiRNA Agents (Asymmetrics)

| | | |
|---|---|---|
| TTR-27 | 5'-UGACUAAGUCAAUAAUCAGAAUCag-3' | (SEQ ID NO: 1) |
| | 3'-CAACUGAUUCAGUUAUUAGUCUUAGUC-5' | (SEQ ID NO: 385) |
| TTR-27 Target: | 5'-GTTGACTAAGTCAATAATCAGAATCAG-3' | (SEQ ID NO: 769) |
| TTR-28 | 5'-GACUAAGUCAAUAAUCAGAAUCAgc-3' | (SEQ ID NO: 2) |
| | 3'-AACUGAUUCAGUUAUUAGUCUUAGUCG-5' | (SEQ ID NO: 386) |
| TTR-28 Target: | 5'-TTGACTAAGTCAATAATCAGAATCAGC-3' | (SEQ ID NO: 770) |
| TTR-29 | 5'-ACUAAGUCAAUAAUCAGAAUCAGca-3' | (SEQ ID NO: 3) |
| | 3'-ACUGAUUCAGUUAUUAGUCUUAGUCGU-5' | (SEQ ID NO: 387) |
| TTR-29 Target: | 5'-TGACTAAGTCAATAATCAGAATCAGCA-3' | (SEQ ID NO: 771) |
| TTR-30 | 5'-CUAAGUCAAUAAUCAGAAUCAGCag-3' | (SEQ ID NO: 4) |
| | 3'-CUGAUUCAGUUAUUAGUCUUAGUCGUC-5' | (SEQ ID NO: 388) |
| TTR-30 Target: | 5'-GACTAAGTCAATAATCAGAATCAGCAG-3' | (SEQ ID NO: 772) |
| TTR-31 | 5'-UAAGUCAAUAAUCAGAAUCAGCAgg-3' | (SEQ ID NO: 5) |
| | 3'-UGAUUCAGUUAUUAGUCUUAGUCGUCC-5' | (SEQ ID NO: 389) |
| TTR-31 Target: | 5'-ACTAAGTCAATAATCAGAATCAGCAGG-3' | (SEQ ID NO: 773) |
| TTR-32 | 5'-AAGUCAAUAAUCAGAAUCAGCAGgt-3' | (SEQ ID NO: 6) |
| | 3'-GAUUCAGUUAUUAGUCUUAGUCGUCCA-5' | (SEQ ID NO: 390) |
| TTR-32 Target: | 5'-CTAAGTCAATAATCAGAATCAGCAGGT-3' | (SEQ ID NO: 774) |
| TTR-33 | 5'-AGUCAAUAAUCAGAAUCAGCAGGtt-3' | (SEQ ID NO: 7) |
| | 3'-AUUCAGUUAUUAGUCUUAGUCGUCCAA-5' | (SEQ ID NO: 391) |
| TTR-33 Target: | 5'-TAAGTCAATAATCAGAATCAGCAGGTT-3' | (SEQ ID NO: 775) |
| TTR-34 | 5'-GUCAAUAAUCAGAAUCAGCAGGUtt-3' | (SEQ ID NO: 8) |
| | 3'-UUCAGUUAUUAGUCUUAGUCGUCCAAA-5' | (SEQ ID NO: 392) |
| TTR-34 Target: | 5'-AAGTCAATAATCAGAATCAGCAGGTTT-3' | (SEQ ID NO: 776) |
| TTR-35 | 5'-UCAAUAAUCAGAAUCAGCAGGUUtg-3' | (SEQ ID NO: 9) |
| | 3'-UCAGUUAUUAGUCUUAGUCGUCCAAAC-5' | (SEQ ID NO: 393) |
| TTR-35 Target: | 5'-AGTCAATAATCAGAATCAGCAGGTTTG-3' | (SEQ ID NO: 777) |
| TTR-36 | 5'-CAAUAAUCAGAAUCAGCAGGUUUgc-3' | (SEQ ID NO: 10) |
| | 3'-CAGUUAUUAGUCUUAGUCGUCCAAACG-5' | (SEQ ID NO: 394) |
| TTR-36 Target: | 5'-GTCAATAATCAGAATCAGCAGGTTTGC-3' | (SEQ ID NO: 778) |
| TTR-37 | 5'-AAUAAUCAGAAUCAGCAGGUUUGca-3' | (SEQ ID NO: 11) |
| | 3'-AGUUAUUAGUCUUAGUCGUCCAAACGU-5' | (SEQ ID NO: 395) |
| TTR-37 Target: | 5'-TCAATAATCAGAATCAGCAGGTTTGCA-3' | (SEQ ID NO: 779) |
| TTR-38 | 5'-AUAAUCAGAAUCAGCAGGUUUGCag-3' | (SEQ ID NO: 12) |
| | 3'-GUUAUUAGUCUUAGUCGUCCAAACGUC-5' | (SEQ ID NO: 396) |
| TTR-38 Target: | 5'-CAATAATCAGAATCAGCAGGTTTGCAG-3' | (SEQ ID NO: 780) |
| TTR-39 | 5'-UAAUCAGAAUCAGCAGGUUUGCAgt-3' | (SEQ ID NO: 13) |
| | 3'-UUAUUAGUCUUAGUCGUCCAAACGUCA-5' | (SEQ ID NO: 397) |
| TTR-39 Target: | 5'-AATAATCAGAATCAGCAGGTTTGCAGT-3' | (SEQ ID NO: 781) |
| TTR-40 | 5'-AAUCAGAAUCAGCAGGUUUGCAGtc-3' | (SEQ ID NO: 14) |
| | 3'-UAUUAGUCUUAGUCGUCCAAACGUCAG-5' | (SEQ ID NO: 398) |
| TTR-40 Target: | 5'-ATAATCAGAATCAGCAGGTTTGCAGTC-3' | (SEQ ID NO: 782) |
| TTR-41 | 5'-AUCAGAAUCAGCAGGUUUGCAGUca-3' | (SEQ ID NO: 15) |
| | 3'-AUUAGUCUUAGUCGUCCAAACGUCAGU-5' | (SEQ ID NO: 399) |
| TTR-41 Target: | 5'-TAATCAGAATCAGCAGGTTTGCAGTCA-3' | (SEQ ID NO: 783) |
| TTR-43 | 5'-CAGAAUCAGCAGGUUUGCAGUCAga-3' | (SEQ ID NO: 16) |
| | 3'-UAGUCUUAGUCGUCCAAACGUCAGUCU-5' | (SEQ ID NO: 400) |
| TTR-43 Target: | 5'-ATCAGAATCAGCAGGTTTGCAGTCAGA-3' | (SEQ ID NO: 784) |
| TTR-44 | 5'-AGAAUCAGCAGGUUUGCAGUCAGat-3' | (SEQ ID NO: 17) |
| | 3'-AGUCUUAGUCGUCCAAACGUCAGUCUA-5' | (SEQ ID NO: 401) |
| TTR-44 Target: | 5'-TCAGAATCAGCAGGTTTGCAGTCAGAT-3' | (SEQ ID NO: 785) |
| TTR-46 | 5'-AAUCAGCAGGUUUGCAGUCAGAUtg-3' | (SEQ ID NO: 18) |
| | 3'-UCUUAGUCGUCCAAACGUCAGUCUAAC-5' | (SEQ ID NO: 402) |
| TTR-46 Target: | 5'-AGAATCAGCAGGTTTGCAGTCAGATTG-3' | (SEQ ID NO: 786) |
| TTR-47 | 5'-AUCAGCAGGUUUGCAGUCAGAUUgg-3' | (SEQ ID NO: 19) |
| | 3'-CUUAGUCGUCCAAACGUCAGUCUAACC-5' | (SEQ ID NO: 403) |
| TTR-47 Target: | 5'-GAATCAGCAGGTTTGCAGTCAGATTGG-3' | (SEQ ID NO: 787) |

TABLE 2-continued

Selected Human Anti-transthyretin DsiRNA Agents (Asymmetrics)

| | | |
|---|---|---|
| TTR-59 Target: | 5'-GCAGUCAGAUUGGCAGGGAUAAGca-3'<br>3'-AACGUCAGUCUAACCGUCCCUAUUCGU-5'<br>5'-TTGCAGTCAGATTGGCAGGGATAAGCA-3' | (SEQ ID NO: 20)<br>(SEQ ID NO: 404)<br>(SEQ ID NO: 788) |
| TTR-84 Target: | 5'-GCCUAGCUCAGGAGAAGUGAGUAta-3'<br>3'-GUCGGAUCGAGUCCUCUUCACUCAUAU-5'<br>5'-CAGCCTAGCTCAGGAGAAGTGAGTATA-3' | (SEQ ID NO: 21)<br>(SEQ ID NO: 405)<br>(SEQ ID NO: 789) |
| TTR-87 Target: | 5'-UAGCUCAGGAGAAGUGAGUAUAAaa-3'<br>3'-GGAUCGAGUCCUCUUCACUCAUAUUUU-5'<br>5'-CCTAGCTCAGGAGAAGTGAGTATAAAA-3' | (SEQ ID NO: 22)<br>(SEQ ID NO: 406)<br>(SEQ ID NO: 790) |
| TTR-88 Target: | 5'-AGCUCAGGAGAAGUGAGUAUAAAag-3'<br>3'-GAUCGAGUCCUCUUCACUCAUAUUUUC-5'<br>5'-CTAGCTCAGGAGAAGTGAGTATAAAAG-3' | (SEQ ID NO: 23)<br>(SEQ ID NO: 407)<br>(SEQ ID NO: 791) |
| TTR-89 Target: | 5'-GCUCAGGAGAAGUGAGUAUAAAAgc-3'<br>3'-AUCGAGUCCUCUUCACUCAUAUUUUCG-5'<br>5'-TAGCTCAGGAGAAGTGAGTATAAAAGC-3' | (SEQ ID NO: 24)<br>(SEQ ID NO: 408)<br>(SEQ ID NO: 792) |
| TTR-90 Target: | 5'-CUCAGGAGAAGUGAGUAUAAAAGcc-3'<br>3'-UCGAGUCCUCUUCACUCAUAUUUUCGG-5'<br>5'-AGCTCAGGAGAAGTGAGTATAAAAGCC-3' | (SEQ ID NO: 25)<br>(SEQ ID NO: 409)<br>(SEQ ID NO: 793) |
| TTR-92 Target: | 5'-CAGGAGAAGUGAGUAUAAAAGCCcc-3'<br>3'-GAGUCCUCUUCACUCAUAUUUUCGGGG-5'<br>5'-CTCAGGAGAAGTGAGTATAAAAGCCCC-3' | (SEQ ID NO: 26)<br>(SEQ ID NO: 410)<br>(SEQ ID NO: 794) |
| TTR-126 Target: | 5'-GCAGCCAUCACAGAAGUCCACUCat-3'<br>3'-CUCGUCGGUAGUGUCUUCAGGUGAGUA-5'<br>5'-GAGCAGCCATCACAGAAGTCCACTCAT-3' | (SEQ ID NO: 27)<br>(SEQ ID NO: 411)<br>(SEQ ID NO: 795) |
| TTR-127 Target: | 5'-CAGCCAUCACAGAAGUCCACUCAtt-3'<br>3'-UCGUCGGUAGUGUCUUCAGGUGAGUAA-5'<br>5'-AGCAGCCATCACAGAAGTCCACTCATT-3' | (SEQ ID NO: 28)<br>(SEQ ID NO: 412)<br>(SEQ ID NO: 796) |
| TTR-128 Target: | 5'-AGCCAUCACAGAAGUCCACUCAUtc-3'<br>3'-CGUCGGUAGUGUCUUCAGGUGAGUAAG-5'<br>5'-GCAGCCATCACAGAAGTCCACTCATTC-3' | (SEQ ID NO: 29)<br>(SEQ ID NO: 413)<br>(SEQ ID NO: 797) |
| TTR-129 Target: | 5'-GCCAUCACAGAAGUCCACUCAUUct-3'<br>3'-GUCGGUAGUGUCUUCAGGUGAGUAAGA-5'<br>5'-CAGCCATCACAGAAGTCCACTCATTCT-3' | (SEQ ID NO: 30)<br>(SEQ ID NO: 414)<br>(SEQ ID NO: 798) |
| TTR-130 Target: | 5'-CCAUCACAGAAGUCCACUCAUUCtt-3'<br>3'-UCGGUAGUGUCUUCAGGUGAGUAAGAA-5'<br>5'-AGCCATCACAGAAGTCCACTCATTCTT-3' | (SEQ ID NO: 31)<br>(SEQ ID NO: 415)<br>(SEQ ID NO: 799) |
| TTR-131 Target: | 5'-CAUCACAGAAGUCCACUCAUUCUtg-3'<br>3'-CGGUAGUGUCUUCAGGUGAGUAAGAAC-5'<br>5'-GCCATCACAGAAGTCCACTCATTCTTG-3' | (SEQ ID NO: 32)<br>(SEQ ID NO: 416)<br>(SEQ ID NO: 800) |
| TTR-132 Target: | 5'-AUCACAGAAGUCCACUCAUUCUUgg-3'<br>3'-GGUAGUGUCUUCAGGUGAGUAAGAACC-5'<br>5'-CCATCACAGAAGTCCACTCATTCTTGG-3' | (SEQ ID NO: 33)<br>(SEQ ID NO: 417)<br>(SEQ ID NO: 801) |
| TTR-134 Target: | 5'-CACAGAAGUCCACUCAUUCUUGGca-3'<br>3'-UAGUGUCUUCAGGUGAGUAAGAACCGU-5'<br>5'-ATCACAGAAGTCCACTCATTCTTGGCA-3' | (SEQ ID NO: 34)<br>(SEQ ID NO: 418)<br>(SEQ ID NO: 802) |
| TTR-135 Target: | 5'-ACAGAAGUCCACUCAUUCUUGGCag-3'<br>3'-AGUGUCUUCAGGUGAGUAAGAACCGUC-5'<br>5'-TCACAGAAGTCCACTCATTCTTGGCAG-3' | (SEQ ID NO: 35)<br>(SEQ ID NO: 419)<br>(SEQ ID NO: 803) |
| TTR-150 Target: | 5'-UUCUUGGCAGGAUGGCUUCUCAUcg-3'<br>3'-GUAAGAACCGUCCUACCGAAGAGUAGC-5'<br>5'-CATTCTTGGCAGGATGGCTTCTCATCG-3' | (SEQ ID NO: 36)<br>(SEQ ID NO: 420)<br>(SEQ ID NO: 804) |
| TTR-151 Target: | 5'-UCUUGGCAGGAUGGCUUCUCAUCgt-3'<br>3'-UAAGAACCGUCCUACCGAAGAGUAGCA-5'<br>5'-ATTCTTGGCAGGATGGCTTCTCATCGT-3' | (SEQ ID NO: 37)<br>(SEQ ID NO: 421)<br>(SEQ ID NO: 805) |
| TTR-152 Target: | 5'-CUUGGCAGGAUGGCUUCUCAUCGtc-3'<br>3'-AAGAACCGUCCUACCGAAGAGUAGCAG-5'<br>5'-TTCTTGGCAGGATGGCTTCTCATCGTC-3' | (SEQ ID NO: 38)<br>(SEQ ID NO: 422)<br>(SEQ ID NO: 806) |
| | 5'-UUGGCAGGAUGGCUUCUCAUCGUct-3'<br>3'-AGAACCGUCCUACCGAAGAGUAGCAGA-5' | (SEQ ID NO: 39)<br>(SEQ ID NO: 423) |

TABLE 2-continued

Selected Human Anti-transthyretin DsiRNA Agents (Asymmetrics)

```
TTR-153   Target:  5'-TCTTGGCAGGATGGCTTCTCATCGTCT-3'       (SEQ ID NO: 807)

5'-UGGCAGGAUGGCUUCUCAUCGUCtg-3'          (SEQ ID NO: 40)
                   3'-GAACCGUCCUACCGAAGAGUAGCAGAC-5'        (SEQ ID NO: 424)
TTR-154   Target:  5'-CTTGGCAGGATGGCTTCTCATCGTCTG-3'       (SEQ ID NO: 808)

5'-GGCAGGAUGGCUUCUCAUCGUCUgc-3'          (SEQ ID NO: 41)
                   3'-AACCGUCCUACCGAAGAGUAGCAGACG-5'        (SEQ ID NO: 425)
TTR-155   Target:  5'-TTGGCAGGATGGCTTCTCATCGTCTGC-3'       (SEQ ID NO: 809)

5'-GCAGGAUGGCUUCUCAUCGUCUGct-3'          (SEQ ID NO: 42)
                   3'-ACCGUCCUACCGAAGAGUAGCAGACGA-5'        (SEQ ID NO: 426)
TTR-156   Target:  5'-TGGCAGGATGGCTTCTCATCGTCTGCT-3'       (SEQ ID NO: 810)

5'-CAGGAUGGCUUCUCAUCGUCUGCtc-3'          (SEQ ID NO: 43)
                   3'-CCGUCCUACCGAAGAGUAGCAGACGAG-5'        (SEQ ID NO: 427)
TTR-157   Target:  5'-GGCAGGATGGCTTCTCATCGTCTGCTC-3'       (SEQ ID NO: 811)

5'-AGGAUGGCUUCUCAUCGUCUGCUcc-3'          (SEQ ID NO: 44)
                   3'-CGUCCUACCGAAGAGUAGCAGACGAGG-5'        (SEQ ID NO: 428)
TTR-158   Target:  5'-GCAGGATGGCTTCTCATCGTCTGCTCC-3'       (SEQ ID NO: 812)

5'-GGAUGGCUUCUCAUCGUCUGCUCct-3'          (SEQ ID NO: 45)
                   3'-GUCCUACCGAAGAGUAGCAGACGAGGA-5'        (SEQ ID NO: 429)
TTR-159   Target:  5'-CAGGATGGCTTCTCATCGTCTGCTCCT-3'       (SEQ ID NO: 813)

5'-GAUGGCUUCUCAUCGUCUGCUCCtc-3'          (SEQ ID NO: 46)
                   3'-UCCUACCGAAGAGUAGCAGACGAGGAG-5'        (SEQ ID NO: 430)
TTR-160   Target:  5'-AGGATGGCTTCTCATCGTCTGCTCCTC-3'       (SEQ ID NO: 814)

5'-AUGGCUUCUCAUCGUCUGCUCCUcc-3'          (SEQ ID NO: 47)
                   3'-CCUACCGAAGAGUAGCAGACGAGGAGG-5'        (SEQ ID NO: 431)
TTR-161   Target:  5'-GGATGGCTTCTCATCGTCTGCTCCTCC-3'       (SEQ ID NO: 815)

5'-UGGCUUCUCAUCGUCUGCUCCUCct-3'          (SEQ ID NO: 48)
                   3'-CUACCGAAGAGUAGCAGACGAGGAGGA-5'        (SEQ ID NO: 432)
TTR-162   Target:  5'-GATGGCTTCTCATCGTCTGCTCCTCCT-3'       (SEQ ID NO: 816)

5'-GGCUUCUCAUCGUCUGCUCCUCCtc-3'          (SEQ ID NO: 49)
                   3'-UACCGAAGAGUAGCAGACGAGGAGGAG-5'        (SEQ ID NO: 433)
TTR-163   Target:  5'-ATGGCTTCTCATCGTCTGCTCCTCCTC-3'       (SEQ ID NO: 817)

5'-GCUUCUCAUCGUCUGCUCCUCCUct-3'          (SEQ ID NO: 50)
                   3'-ACCGAAGAGUAGCAGACGAGGAGGAGA-5'        (SEQ ID NO: 434)
TTR-164   Target:  5'-TGGCTTCTCATCGTCTGCTCCTCCTCT-3'       (SEQ ID NO: 818)

5'-CUUCUCAUCGUCUGCUCCUCCUCtg-3'          (SEQ ID NO: 51)
                   3'-CCGAAGAGUAGCAGACGAGGAGGAGAC-5'        (SEQ ID NO: 435)
TTR-165   Target:  5'-GGCTTCTCATCGTCTGCTCCTCCTCTG-3'       (SEQ ID NO: 819)

5'-UCUGCCUUGCUGGACUGGUAUUUgt-3'          (SEQ ID NO: 52)
                   3'-GGAGACGGAACGACCUGACCAUAAACA-5'        (SEQ ID NO: 436)
TTR-186   Target:  5'-CCTCTGCCTTGCTGGACTGGTATTTGT-3'       (SEQ ID NO: 820)

5'-CUGCCUUGCUGGACUGGUAUUUGtg-3'          (SEQ ID NO: 53)
                   3'-GAGACGGAACGACCUGACCAUAAACAC-5'        (SEQ ID NO: 437)
TTR-187   Target:  5'-CTCTGCCTTGCTGGACTGGTATTTGTG-3'       (SEQ ID NO: 821)

5'-CCGGUGAAUCCAAGUGUCCUCUGat-3'          (SEQ ID NO: 54)
                   3'-GUGGCCACUUAGGUUCACAGGAGACUA-5'        (SEQ ID NO: 438)
TTR-234   Target:  5'-CACCGGTGAATCCAAGTGTCCTCTGAT-3'       (SEQ ID NO: 822)

5'-UGAAUCCAAGUGUCCUCUGAUGGtc-3'          (SEQ ID NO: 55)
                   3'-CCACUUAGGUUCACAGGAGACUACCAG-5'        (SEQ ID NO: 439)
TTR-238   Target:  5'-GGTGAATCCAAGTGTCCTCTGATGGTC-3'       (SEQ ID NO: 823)

5'-GAAUCCAAGUGUCCUCUGAUGGUca-3'          (SEQ ID NO: 56)
                   3'-CACUUAGGUUCACAGGAGACUACCAGU-5'        (SEQ ID NO: 440)
TTR-239   Target:  5'-GTGAATCCAAGTGTCCTCTGATGGTCA-3'       (SEQ ID NO: 824)

5'-AAUCCAAGUGUCCUCUGAUGGUCaa-3'          (SEQ ID NO: 57)
                   3'-ACUUAGGUUCACAGGAGACUACCAGUU-5'        (SEQ ID NO: 441)
TTR-240   Target:  5'-TGAATCCAAGTGTCCTCTGATGGTCAA-3'       (SEQ ID NO: 825)

5'-AUCCAAGUGUCCUCUGAUGGUCAaa-3'          (SEQ ID NO: 58)
                   3'-CUUAGGUUCACAGGAGACUACCAGUUU-5'        (SEQ ID NO: 442)
TTR-241   Target:  5'-GAATCCAAGTGTCCTCTGATGGTCAAA-3'       (SEQ ID NO: 826)
```

TABLE 2-continued

Selected Human Anti-transthyretin DsiRNA Agents (Asymmetrics)

| | | |
|---|---|---|
| TTR-242 Target: | 5'-UCCAAGUGUCCUCUGAUGGUCAAag-3'<br>3'-UUAGGUUCACAGGAGACUACCAGUUUC-5'<br>5'-AATCCAAGTGTCCTCTGATGGTCAAAG-3' | (SEQ ID NO: 59)<br>(SEQ ID NO: 443)<br>(SEQ ID NO: 827) |
| TTR-243 Target: | 5'-CCAAGUGUCCUCUGAUGGUCAAAgt-3'<br>3'-UAGGUUCACAGGAGACUACCAGUUUCA-5'<br>5'-ATCCAAGTGTCCTCTGATGGTCAAAGT-3' | (SEQ ID NO: 60)<br>(SEQ ID NO: 444)<br>(SEQ ID NO: 828) |
| TTR-244 Target: | 5'-CAAGUGUCCUCUGAUGGUCAAAGtt-3'<br>3'-AGGUUCACAGGAGACUACCAGUUUCAA-5'<br>5'-TCCAAGTGTCCTCTGATGGTCAAAGTT-3' | (SEQ ID NO: 61)<br>(SEQ ID NO: 445)<br>(SEQ ID NO: 829) |
| TTR-245 Target: | 5'-AAGUGUCCUCUGAUGGUCAAAGUtc-3'<br>3'-GGUUCACAGGAGACUACCAGUUUCAAG-5'<br>5'-CCAAGTGTCCTCTGATGGTCAAAGTTC-3' | (SEQ ID NO: 62)<br>(SEQ ID NO: 446)<br>(SEQ ID NO: 830) |
| TTR-246 Target: | 5'-AGUGUCCUCUGAUGGUCAAAGUUct-3'<br>3'-GUUCACAGGAGACUACCAGUUUCAAGA-5'<br>5'-CAAGTGTCCTCTGATGGTCAAAGTTCT-3' | (SEQ ID NO: 63)<br>(SEQ ID NO: 447)<br>(SEQ ID NO: 831) |
| TTR-247 Target: | 5'-GUGUCCUCUGAUGGUCAAAGUUCta-3'<br>3'-UUCACAGGAGACUACCAGUUUCAAGAU-5'<br>5'-AAGTGTCCTCTGATGGTCAAAGTTCTA-3' | (SEQ ID NO: 64)<br>(SEQ ID NO: 448)<br>(SEQ ID NO: 832) |
| TTR-248 Target: | 5'-UGUCCUCUGAUGGUCAAAGUUCUag-3'<br>3'-UCACAGGAGACUACCAGUUUCAAGAUC-5'<br>5'-AGTGTCCTCTGATGGTCAAAGTTCTAG-3' | (SEQ ID NO: 65)<br>(SEQ ID NO: 449)<br>(SEQ ID NO: 833) |
| TTR-249 Target: | 5'-GUCCUCUGAUGGUCAAAGUUCUAga-3'<br>3'-CACAGGAGACUACCAGUUUCAAGAUCU-5'<br>5'-GTGTCCTCTGATGGTCAAAGTTCTAGA-3' | (SEQ ID NO: 66)<br>(SEQ ID NO: 450)<br>(SEQ ID NO: 834) |
| TTR-250 Target: | 5'-UCCUCUGAUGGUCAAAGUUCUAGat-3'<br>3'-ACAGGAGACUACCAGUUUCAAGAUCUA-5'<br>5'-TGTCCTCTGATGGTCAAAGTTCTAGAT-3' | (SEQ ID NO: 67)<br>(SEQ ID NO: 451)<br>(SEQ ID NO: 835) |
| TTR-251 Target: | 5'-CCUCUGAUGGUCAAAGUUCUAGAtg-3'<br>3'-CAGGAGACUACCAGUUUCAAGAUCUAC-5'<br>5'-GTCCTCTGATGGTCAAAGTTCTAGATG-3' | (SEQ ID NO: 68)<br>(SEQ ID NO: 452)<br>(SEQ ID NO: 836) |
| TTR-252 Target: | 5'-CUCUGAUGGUCAAAGUUCUAGAUgc-3'<br>3'-AGGAGACUACCAGUUUCAAGAUCUACG-5'<br>5'-TCCTCTGATGGTCAAAGTTCTAGATGC-3' | (SEQ ID NO: 69)<br>(SEQ ID NO: 453)<br>(SEQ ID NO: 837) |
| TTR-253 Target: | 5'-UCUGAUGGUCAAAGUUCUAGAUGct-3'<br>3'-GGAGACUACCAGUUUCAAGAUCUACGA-5'<br>5'-CCTCTGATGGTCAAAGTTCTAGATGCT-3' | (SEQ ID NO: 70)<br>(SEQ ID NO: 454)<br>(SEQ ID NO: 838) |
| TTR-254 Target: | 5'-CUGAUGGUCAAAGUUCUAGAUGCtg-3'<br>3'-GAGACUACCAGUUUCAAGAUCUACGAC-5'<br>5'-CTCTGATGGTCAAAGTTCTAGATGCTG-3' | (SEQ ID NO: 71)<br>(SEQ ID NO: 455)<br>(SEQ ID NO: 839) |
| TTR-255 Target: | 5'-UGAUGGUCAAAGUUCUAGAUGCUgt-3'<br>3'-AGACUACCAGUUUCAAGAUCUACGACA-5'<br>5'-TCTGATGGTCAAAGTTCTAGATGCTGT-3' | (SEQ ID NO: 72)<br>(SEQ ID NO: 456)<br>(SEQ ID NO: 840) |
| TTR-256 Target: | 5'-GAUGGUCAAAGUUCUAGAUGCUGtc-3'<br>3'-GACUACCAGUUUCAAGAUCUACGACAG-5'<br>5'-CTGATGGTCAAAGTTCTAGATGCTGTC-3' | (SEQ ID NO: 73)<br>(SEQ ID NO: 457)<br>(SEQ ID NO: 841) |
| TTR-257 Target: | 5'-AUGGUCAAAGUUCUAGAUGCUGUcc-3'<br>3'-ACUACCAGUUUCAAGAUCUACGACAGG-5'<br>5'-TGATGGTCAAAGTTCTAGATGCTGTCC-3' | (SEQ ID NO: 74)<br>(SEQ ID NO: 458)<br>(SEQ ID NO: 842) |
| TTR-258 Target: | 5'-UGGUCAAAGUUCUAGAUGCUGUCcg-3'<br>3'-CUACCAGUUUCAAGAUCUACGACAGGC-5'<br>5'-GATGGTCAAAGTTCTAGATGCTGTCCG-3' | (SEQ ID NO: 75)<br>(SEQ ID NO: 459)<br>(SEQ ID NO: 843) |
| TTR-346 Target: | 5'-GCCAUUUGCCUCUGGGAAAACCAgt-3'<br>3'-CUCGGUAAACGGAGACCCUUUUGGUCA-5'<br>5'-GAGCCATTTGCCTCTGGGAAAACCAGT-3' | (SEQ ID NO: 76)<br>(SEQ ID NO: 460)<br>(SEQ ID NO: 844) |
| TTR-347 Target: | 5'-CCAUUUGCCUCUGGGAAAACCAGtg-3'<br>3'-UCGGUAAACGGAGACCCUUUUGGUCAC-5'<br>5'-AGCCATTTGCCTCTGGGAAAACCAGTG-3' | (SEQ ID NO: 77)<br>(SEQ ID NO: 461)<br>(SEQ ID NO: 845) |

TABLE 2-continued

Selected Human Anti-transthyretin DsiRNA Agents (Asymmetrics)

|  | | |
|---|---|---|
| | 5'-CAUUUGCCUCUGGGAAAACCAGUGa-3' | (SEQ ID NO: 78) |
| | 3'-CGGUAAACGGAGACCCUUUUGGUCACU-5' | (SEQ ID NO: 462) |
| TTR-348 Target: | 5'-GCCATTTGCCTCTGGGAAAACCAGTGA-3' | (SEQ ID NO: 846) |
| | 5'-AUUUGCCUCUGGGAAAACCAGUGag-3' | (SEQ ID NO: 79) |
| | 3'-GGUAAACGGAGACCCUUUUGGUCACUC-5' | (SEQ ID NO: 463) |
| TTR-349 Target: | 5'-CCATTTGCCTCTGGGAAAACCAGTGAG-3' | (SEQ ID NO: 847) |
| | 5'-UUUGCCUCUGGGAAAACCAGUGAgt-3' | (SEQ ID NO: 80) |
| | 3'-GUAAACGGAGACCCUUUUGGUCACUCA-5' | (SEQ ID NO: 464) |
| TTR-350 Target: | 5'-CATTTGCCTCTGGGAAAACCAGTGAGT-3' | (SEQ ID NO: 848) |
| | 5'-UUGCCUCUGGGAAAACCAGUGAGtc-3' | (SEQ ID NO: 81) |
| | 3'-UAAACGGAGACCCUUUUGGUCACUCAG-5' | (SEQ ID NO: 465) |
| TTR-351 Target: | 5'-ATTTGCCTCTGGGAAAACCAGTGAGTC-3' | (SEQ ID NO: 849) |
| | 5'-UGCCUCUGGGAAAACCAGUGAGUct-3' | (SEQ ID NO: 82) |
| | 3'-AAACGGAGACCCUUUUGGUCACUCAGA-5' | (SEQ ID NO: 466) |
| TTR-352 Target: | 5'-TTTGCCTCTGGGAAAACCAGTGAGTCT-3' | (SEQ ID NO: 850) |
| | 5'-GCCUCUGGGAAAACCAGUGAGUCtg-3' | (SEQ ID NO: 83) |
| | 3'-AACGGAGACCCUUUUGGUCACUCAGAC-5' | (SEQ ID NO: 467) |
| TTR-353 Target: | 5'-TTGCCTCTGGGAAAACCAGTGAGTCTG-3' | (SEQ ID NO: 851) |
| | 5'-CCUCUGGGAAAACCAGUGAGUCUgg-3' | (SEQ ID NO: 84) |
| | 3'-ACGGAGACCCUUUUGGUCACUCAGACC-5' | (SEQ ID NO: 468) |
| TTR-354 Target: | 5'-TGCCTCTGGGAAAACCAGTGAGTCTGG-3' | (SEQ ID NO: 852) |
| | 5'-CUCUGGGAAAACCAGUGAGUCUGga-3' | (SEQ ID NO: 85) |
| | 3'-CGGAGACCCUUUUGGUCACUCAGACCU-5' | (SEQ ID NO: 469) |
| TTR-355 Target: | 5'-GCCTCTGGGAAAACCAGTGAGTCTGGA-3' | (SEQ ID NO: 853) |
| | 5'-UCUGGGAAAACCAGUGAGUCUGGag-3' | (SEQ ID NO: 86) |
| | 3'-GGAGACCCUUUUGGUCACUCAGACCUC-5' | (SEQ ID NO: 470) |
| TTR-356 Target: | 5'-CCTCTGGGAAAACCAGTGAGTCTGGAG-3' | (SEQ ID NO: 854) |
| | 5'-CUGGGAAAACCAGUGAGUCUGGAga-3' | (SEQ ID NO: 87) |
| | 3'-GAGACCCUUUUGGUCACUCAGACCUCU-5' | (SEQ ID NO: 471) |
| TTR-357 Target: | 5'-CTCTGGGAAAACCAGTGAGTCTGGAGA-3' | (SEQ ID NO: 855) |
| | 5'-UGGGAAAACCAGUGAGUCUGGAGag-3' | (SEQ ID NO: 88) |
| | 3'-AGACCCUUUUGGUCACUCAGACCUCUC-5' | (SEQ ID NO: 472) |
| TTR-358 Target: | 5'-TCTGGGAAAACCAGTGAGTCTGGAGAG-3' | (SEQ ID NO: 856) |
| | 5'-GGGAAAACCAGUGAGUCUGGAGAGc-3' | (SEQ ID NO: 89) |
| | 3'-GACCCUUUUGGUCACUCAGACCUCUCG-5' | (SEQ ID NO: 473) |
| TTR-359 Target: | 5'-CTGGGAAAACCAGTGAGTCTGGAGAGC-3' | (SEQ ID NO: 857) |
| | 5'-GGAAAACCAGUGAGUCUGGAGAGct-3' | (SEQ ID NO: 90) |
| | 3'-ACCCUUUUGGUCACUCAGACCUCUCGA-5' | (SEQ ID NO: 474) |
| TTR-360 Target: | 5'-TGGGAAAACCAGTGAGTCTGGAGAGCT-3' | (SEQ ID NO: 858) |
| | 5'-GAAAACCAGUGAGUCUGGAGAGCtg-3' | (SEQ ID NO: 91) |
| | 3'-CCCUUUUGGUCACUCAGACCUCUCGAC-5' | (SEQ ID NO: 475) |
| TTR-361 Target: | 5'-GGGAAAACCAGTGAGTCTGGAGAGCTG-3' | (SEQ ID NO: 859) |
| | 5'-AGCUGCAUGGGCUCACAACUGAGga-3' | (SEQ ID NO: 92) |
| | 3'-UCUCGACGUACCCGAGUGUUGACUCCU-5' | (SEQ ID NO: 476) |
| TTR-381 Target: | 5'-AGAGCTGCATGGGCTCACAACTGAGGA-3' | (SEQ ID NO: 860) |
| | 5'-GCUGCAUGGGCUCACAACUGAGGag-3' | (SEQ ID NO: 93) |
| | 3'-CUCGACGUACCCGAGUGUUGACUCCUC-5' | (SEQ ID NO: 477) |
| TTR-382 Target: | 5'-GAGCTGCATGGGCTCACAACTGAGGAG-3' | (SEQ ID NO: 861) |
| | 5'-CUGCAUGGGCUCACAACUGAGGAgg-3' | (SEQ ID NO: 94) |
| | 3'-UCGACGUACCCGAGUGUUGACUCCUCC-5' | (SEQ ID NO: 478) |
| TTR-383 Target: | 5'-AGCTGCATGGGCTCACAACTGAGGAGG-3' | (SEQ ID NO: 862) |
| | 5'-UGCAUGGGCUCACAACUGAGGAGga-3' | (SEQ ID NO: 95) |
| | 3'-CGACGUACCCGAGUGUUGACUCCUCCU-5' | (SEQ ID NO: 479) |
| TTR-384 Target: | 5'-GCTGCATGGGCTCACAACTGAGGAGGA-3' | (SEQ ID NO: 863) |
| | 5'-GCAUGGGCUCACAACUGAGGAGGaa-3' | (SEQ ID NO: 96) |
| | 3'-GACGUACCCGAGUGUUGACUCCUCCUU-5' | (SEQ ID NO: 480) |
| TTR-385 Target: | 5'-CTGCATGGGCTCACAACTGAGGAGGAA-3' | (SEQ ID NO: 864) |

TABLE 2-continued

Selected Human Anti-transthyretin DsiRNA Agents (Asymmetrics)

| | | |
|---|---|---|
| TTR-386 Target: | 5'-CAUGGGCUCACAACUGAGGAGGAat-3'<br>3'-ACGUACCCGAGUGUUGACUCCUCCUUA-5'<br>5'-TGCATGGGCTCACAACTGAGGAGGAAT-3' | (SEQ ID NO: 97)<br>(SEQ ID NO: 481)<br>(SEQ ID NO: 865) |
| TTR-387 Target: | 5'-AUGGGCUCACAACUGAGGAGGAAtt-3'<br>3'-CGUACCCGAGUGUUGACUCCUCCUUAA-5'<br>5'-GCATGGGCTCACAACTGAGGAGGAATT-3' | (SEQ ID NO: 98)<br>(SEQ ID NO: 482)<br>(SEQ ID NO: 866) |
| TTR-388 Target: | 5'-UGGGCUCACAACUGAGGAGGAAUtt-3'<br>3'-GUACCCGAGUGUUGACUCCUCCUUAAA-5'<br>5'-CATGGGCTCACAACTGAGGAGGAATTT-3' | (SEQ ID NO: 99)<br>(SEQ ID NO: 483)<br>(SEQ ID NO: 867) |
| TTR-389 Target: | 5'-GGGCUCACAACUGAGGAGGAAUUtg-3'<br>3'-UACCCGAGUGUUGACUCCUCCUUAAAC-5'<br>5'-ATGGGCTCACAACTGAGGAGGAATTTG-3' | (SEQ ID NO: 100)<br>(SEQ ID NO: 484)<br>(SEQ ID NO: 868) |
| TTR-390 Target: | 5'-GGCUCACAACUGAGGAGGAAUUUgt-3'<br>3'-ACCCGAGUGUUGACUCCUCCUUAAACA-5'<br>5'-TGGGCTCACAACTGAGGAGGAATTTGT-3' | (SEQ ID NO: 101)<br>(SEQ ID NO: 485)<br>(SEQ ID NO: 869) |
| TTR-391 Target: | 5'-GCUCACAACUGAGGAGGAAUUUGta-3'<br>3'-CCCGAGUGUUGACUCCUCCUUAAACAU-5'<br>5'-GGGCTCACAACTGAGGAGGAATTTGTA-3' | (SEQ ID NO: 102)<br>(SEQ ID NO: 486)<br>(SEQ ID NO: 870) |
| TTR-392 Target: | 5'-CUCACAACUGAGGAGGAAUUUGUag-3'<br>3'-CCGAGUGUUGACUCCUCCUUAAACAUC-5'<br>5'-GGCTCACAACTGAGGAGGAATTTGTAG-3' | (SEQ ID NO: 103)<br>(SEQ ID NO: 487)<br>(SEQ ID NO: 871) |
| TTR-393 Target: | 5'-UCACAACUGAGGAGGAAUUUGUAga-3'<br>3'-CGAGUGUUGACUCCUCCUUAAACAUCU-5'<br>5'-GCTCACAACTGAGGAGGAATTTGTAGA-3' | (SEQ ID NO: 104)<br>(SEQ ID NO: 488)<br>(SEQ ID NO: 872) |
| TTR-394 Target: | 5'-CACAACUGAGGAGGAAUUUGUAGaa-3'<br>3'-GAGUGUUGACUCCUCCUUAAACAUCUU-5'<br>5'-CTCACAACTGAGGAGGAATTTGTAGAA-3' | (SEQ ID NO: 105)<br>(SEQ ID NO: 489)<br>(SEQ ID NO: 873) |
| TTR-395 Target: | 5'-ACAACUGAGGAGGAAUUUGUAGAag-3'<br>3'-AGUGUUGACUCCUCCUUAAACAUCUUC-5'<br>5'-TCACAACTGAGGAGGAATTTGTAGAAG-3' | (SEQ ID NO: 106)<br>(SEQ ID NO: 490)<br>(SEQ ID NO: 874) |
| TTR-396 Target: | 5'-CAACUGAGGAGGAAUUUGUAGAAgg-3'<br>3'-GUGUUGACUCCUCCUUAAACAUCUUCC-5'<br>5'-CACAACTGAGGAGGAATTTGTAGAAGG-3' | (SEQ ID NO: 107)<br>(SEQ ID NO: 491)<br>(SEQ ID NO: 875) |
| TTR-398 Target: | 5'-ACUGAGGAGGAAUUUGUAGAAGGga-3'<br>3'-GUUGACUCCUCCUUAAACAUCUUCCCU-5'<br>5'-CAACTGAGGAGGAATTTGTAGAAGGGA-3' | (SEQ ID NO: 108)<br>(SEQ ID NO: 492)<br>(SEQ ID NO: 876) |
| TTR-399 Target: | 5'-CUGAGGAGGAAUUUGUAGAAGGGat-3'<br>3'-UUGACUCCUCCUUAAACAUCUUCCCUA-5'<br>5'-AACTGAGGAGGAATTTGTAGAAGGGAT-3' | (SEQ ID NO: 109)<br>(SEQ ID NO: 493)<br>(SEQ ID NO: 877) |
| TTR-400 Target: | 5'-UGAGGAGGAAUUUGUAGAAGGGAta-3'<br>3'-UGACUCCUCCUUAAACAUCUUCCCUAU-5'<br>5'-ACTGAGGAGGAATTTGTAGAAGGGATA-3' | (SEQ ID NO: 110)<br>(SEQ ID NO: 494)<br>(SEQ ID NO: 878) |
| TTR-401 Target: | 5'-GAGGAGGAAUUUGUAGAAGGGAUat-3'<br>3'-GACUCCUCCUUAAACAUCUUCCCUAUA-5'<br>5'-CTGAGGAGGAATTTGTAGAAGGGATAT-3' | (SEQ ID NO: 111)<br>(SEQ ID NO: 495)<br>(SEQ ID NO: 879) |
| TTR-402 Target: | 5'-AGGAGGAAUUUGUAGAAGGGAUAta-3'<br>3'-ACUCCUCCUUAAACAUCUUCCCUAUAU-5'<br>5'-TGAGGAGGAATTTGTAGAAGGGATATA-3' | (SEQ ID NO: 112)<br>(SEQ ID NO: 496)<br>(SEQ ID NO: 880) |
| TTR-403 Target: | 5'-GGAGGAAUUUGUAGAAGGGAUAUac-3'<br>3'-CUCCUCCUUAAACAUCUUCCCUAUAUG-5'<br>5'-GAGGAGGAATTTGTAGAAGGGATATAC-3' | (SEQ ID NO: 113)<br>(SEQ ID NO: 497)<br>(SEQ ID NO: 881) |
| TTR-404 Target: | 5'-GAGGAAUUUGUAGAAGGGAUAUCa-3'<br>3'-UCCUCCUUAAACAUCUUCCCUAUAUGU-5'<br>5'-AGGAGGAATTTGTAGAAGGGATATACA-3' | (SEQ ID NO: 114)<br>(SEQ ID NO: 498)<br>(SEQ ID NO: 882) |
| TTR-405 Target: | 5'-AGGAAUUUGUAGAAGGGAUAUACaa-3'<br>3'-CCUCCUUAAACAUCUUCCCUAUAUGUU-5'<br>5'-GGAGGAATTTGTAGAAGGGATATACAA-3' | (SEQ ID NO: 115)<br>(SEQ ID NO: 499)<br>(SEQ ID NO: 883) |

TABLE 2-continued

Selected Human Anti-transthyretin DsiRNA Agents (Asymmetrics)

| | | |
|---|---|---|
| TTR-406 Target: | 5'-GG<u>A</u>AUUGUAGAAG<u>GG</u>AUAUACAaa-3'<br>3'-<u>C</u>UC<u>C</u>UUAAACAUCUU<u>CC</u>UAUAUGUUU-5'<br>5'-GAGGAATTTGTAGAAGGGATATACAAA-3' | (SEQ ID NO: 116)<br>(SEQ ID NO: 500)<br>(SEQ ID NO: 884) |
| TTR-407 Target: | 5'-GA<u>A</u>UUGUAGAAGGG<u>A</u>UAUACAAag-3'<br>3'-<u>U</u>CC<u>U</u>UAAACAUCUU<u>CC</u>UAUAUG<u>U</u>UUC-5'<br>5'-AGGAATTTGTAGAAGGGATATACAAAG-3' | (SEQ ID NO: 117)<br>(SEQ ID NO: 501)<br>(SEQ ID NO: 885) |
| TTR-408 Target: | 5'-A<u>A</u>UUGUAGAAGGG<u>GA</u>UAUACAAAgt-3'<br>3'-<u>CC</u>UU<u>A</u>AACAUCUU<u>CC</u>UAUAUGUU<u>UCA</u>-5'<br>5'-GGAATTTGTAGAAGGGATATACAAAGT-3' | (SEQ ID NO: 118)<br>(SEQ ID NO: 502)<br>(SEQ ID NO: 886) |
| TTR-409 Target: | 5'-A<u>U</u>UUGUAGAAGGG<u>A</u>U<u>A</u>UACAAAGtg-3'<br>3'-<u>C</u>UU<u>A</u>AACAUCUU<u>CC</u>C<u>U</u>AUAUGUU<u>U</u>CAC-5'<br>5'-GAATTTGTAGAAGGGATATACAAAGTG-3' | (SEQ ID NO: 119)<br>(SEQ ID NO: 503)<br>(SEQ ID NO: 887) |
| TTR-410 Target: | 5'-<u>U</u>UUG<u>U</u>AGAAGGG<u>A</u>U<u>A</u>UACAAAGU<u>g</u>g-3'<br>3'-<u>UU</u>A<u>A</u>ACAUCUU<u>CC</u>C<u>U</u>AUAUGUU<u>U</u>CACC-5'<br>5'-AATTTGTAGAAGGGATATACAAAGTGG-3' | (SEQ ID NO: 120)<br>(SEQ ID NO: 504)<br>(SEQ ID NO: 888) |
| TTR-411 Target: | 5'-UUG<u>U</u>AGAAGGG<u>A</u>U<u>A</u>U<u>A</u>CAAAGUGga-3'<br>3'-<u>U</u>A<u>A</u>ACAUCUU<u>CC</u>C<u>U</u>AU<u>A</u>UGUU<u>U</u>CACC<u>U</u>-5'<br>5'-ATTTGTAGAAGGGATATACAAAGTGGA-3' | (SEQ ID NO: 121)<br>(SEQ ID NO: 505)<br>(SEQ ID NO: 889) |
| TTR-412 Target: | 5'-UG<u>U</u>AGAAGGG<u>A</u>U<u>A</u>U<u>AC</u>AAAGUGGaa-3'<br>3'-<u>AA</u>AC<u>A</u>UCUU<u>CC</u>C<u>U</u>AU<u>A</u>UGUU<u>U</u>CA<u>CC</u>UU-5'<br>5'-TTTGTAGAAGGGATATACAAAGTGGAA-3' | (SEQ ID NO: 122)<br>(SEQ ID NO: 506)<br>(SEQ ID NO: 890) |
| TTR-413 Target: | 5'-G<u>U</u>AGAAGGG<u>A</u>U<u>A</u>U<u>AC</u>A<u>A</u>AGUGGaaa-3'<br>3'-<u>AA</u>C<u>A</u>UCUU<u>CC</u>C<u>U</u>AU<u>A</u>UGUUUCA<u>CC</u>UUU-5'<br>5'-TTGTAGAAGGGATATACAAAGTGGAAA-3' | (SEQ ID NO: 123)<br>(SEQ ID NO: 507)<br>(SEQ ID NO: 891) |
| TTR-414 Target: | 5'-<u>U</u>AGAAGGG<u>A</u>U<u>A</u>U<u>A</u>C<u>A</u>AAGUGGAAat-3'<br>3'-<u>AC</u>A<u>U</u>CUU<u>CC</u>C<u>U</u>AU<u>A</u>UGUUUCA<u>CC</u><u>UUU</u>A-5'<br>5'-TGTAGAAGGGATATACAAAGTGGAAAT-3' | (SEQ ID NO: 124)<br>(SEQ ID NO: 508)<br>(SEQ ID NO: 892) |
| TTR-415 Target: | 5'-AG<u>A</u>AGGG<u>A</u>U<u>A</u>U<u>A</u>C<u>A</u>AAGUGGAAAta-3'<br>3'-<u>C</u>A<u>U</u>CUU<u>CC</u>C<u>U</u>AU<u>A</u>UGUUUCA<u>CC</u>UUU<u>A</u>U-5'<br>5'-GTAGAAGGGATATACAAAGTGGAAATA-3' | (SEQ ID NO: 125)<br>(SEQ ID NO: 509)<br>(SEQ ID NO: 893) |
| TTR-416 Target: | 5'-G<u>A</u>AGGG<u>A</u>U<u>A</u>U<u>A</u>C<u>AAA</u>GUGGAAAUag-3'<br>3'-<u>A</u>U<u>C</u>UU<u>CC</u>C<u>U</u>AU<u>A</u>UGUUUCA<u>CC</u>UUU<u>A</u>UC-5'<br>5'-TAGAAGGGATATACAAAGTGGAAATAG-3' | (SEQ ID NO: 126)<br>(SEQ ID NO: 510)<br>(SEQ ID NO: 894) |
| TTR-417 Target: | 5'-A<u>A</u>GGG<u>A</u>U<u>A</u>U<u>A</u>C<u>AA</u>A<u>G</u>UGGAAAUAga-3'<br>3'-<u>U</u>CUU<u>CC</u>C<u>U</u>AU<u>A</u>UGU<u>UU</u>CA<u>CC</u>UUU<u>A</u>UCU-5'<br>5'-AGAAGGGATATACAAAGTGGAAATAGA-3' | (SEQ ID NO: 127)<br>(SEQ ID NO: 511)<br>(SEQ ID NO: 895) |
| TTR-418 Target: | 5'-A<u>GG</u>G<u>A</u>U<u>A</u>UAC<u>AA</u>A<u>G</u>UGGAAAUAGac-3'<br>3'-<u>C</u>UU<u>CCC</u>UAU<u>A</u>UGUUU<u>C</u>A<u>CC</u>UUU<u>A</u>UCUG-5'<br>5'-GAAGGGATATACAAAGTGGAAATAGAC-3' | (SEQ ID NO: 128)<br>(SEQ ID NO: 512)<br>(SEQ ID NO: 896) |
| TTR-419 Target: | 5'-G<u>GG</u>AU<u>A</u>UAC<u>A</u>A<u>AG</u>U<u>GG</u>AAAUAGAca-3'<br>3'-<u>UUCC</u>CUAU<u>A</u>UGUUU<u>C</u>A<u>CC</u>UUU<u>A</u>U<u>C</u>UGU-5'<br>5'-AAGGGATATACAAAGTGGAAATAGACA-3' | (SEQ ID NO: 129)<br>(SEQ ID NO: 513)<br>(SEQ ID NO: 897) |
| TTR-420 Target: | 5'-GG<u>A</u>U<u>A</u>UACAAAGUGG<u>A</u>AAUAGACac-3'<br>3'-<u>U</u>CC<u>C</u>UAU<u>A</u>UGUUUC<u>A</u>CCUUU<u>A</u>UC<u>U</u>GUG-5'<br>5'-AGGGATATACAAAGTGGAAATAGACAC-3' | (SEQ ID NO: 130)<br>(SEQ ID NO: 514)<br>(SEQ ID NO: 898) |
| TTR-421 Target: | 5'-G<u>A</u>U<u>A</u>UCAAAGUGG<u>A</u>A<u>A</u>UAGACAcc-3'<br>3'-<u>CCC</u>U<u>A</u>U<u>A</u>UGUUUC<u>A</u>CCUUU<u>A</u>UC<u>U</u>G<u>U</u>GG-5'<br>5'-GGGATATACAAAGTGGAAATAGACACC-3' | (SEQ ID NO: 131)<br>(SEQ ID NO: 515)<br>(SEQ ID NO: 899) |
| TTR-422 Target: | 5'-<u>A</u>U<u>A</u>UACAAAGUGG<u>AAA</u>UAGACACca-3'<br>3'-<u>CC</u>U<u>A</u>U<u>A</u>UGUUUC<u>A</u>CCUUU<u>A</u>UC<u>U</u>G<u>U</u>GGU-5'<br>5'-GGATATACAAAGTGGAAATAGACACCA-3' | (SEQ ID NO: 132)<br>(SEQ ID NO: 516)<br>(SEQ ID NO: 900) |
| TTR-423 Target: | 5'-U<u>A</u>U<u>A</u>CAAAGUGG<u>AA</u>U<u>A</u>GACACCaa-3'<br>3'-<u>C</u>U<u>A</u>U<u>A</u>UGUUUCACC<u>UU</u>U<u>A</u>UC<u>U</u>G<u>U</u>GG<u>U</u>U-5'<br>5'-GATATACAAAGTGGAAATAGACACCAA-3' | (SEQ ID NO: 133)<br>(SEQ ID NO: 517)<br>(SEQ ID NO: 901) |
| TTR-424 Target: | 5'-<u>A</u>U<u>AC</u>AAAGUGG<u>AA</u>AU<u>A</u>GACACCAaa-3'<br>3'-<u>U</u>A<u>U</u>A<u>U</u>GUUUCACC<u>UU</u>U<u>A</u>UC<u>U</u>G<u>U</u>GG<u>U</u>UU-5'<br>5'-ATATACAAAGTGGAAATAGACACCAAA-3' | (SEQ ID NO: 134)<br>(SEQ ID NO: 518)<br>(SEQ ID NO: 902) |

TABLE 2-continued

Selected Human Anti-transthyretin DsiRNA Agents (Asymmetrics)

|  |  |  |
|---|---|---|
| TTR-425 Target: | 5'-UACAAAGUGGAAAUAGACACCAAat-3'<br>3'-AUAUGUUUCACCUUUAUCUGUGGUUUA-5'<br>5'-TATACAAAGTGGAAATAGACACCAAAT-3' | (SEQ ID NO: 135)<br>(SEQ ID NO: 519)<br>(SEQ ID NO: 903) |
| TTR-426 Target: | 5'-ACAAAGUGGAAAUAGACACCAAAtc-3'<br>3'-UAUGUUUCACCUUUAUCUGUGGUUUAG-5'<br>5'-ATACAAAGTGGAAATAGACACCAAATC-3' | (SEQ ID NO: 136)<br>(SEQ ID NO: 520)<br>(SEQ ID NO: 904) |
| TTR-427 Target: | 5'-CAAAGUGGAAAUAGACACCAAAUct-3'<br>3'-AUGUUUCACCUUUAUCUGUGGUUUAGA-5'<br>5'-TACAAAGTGGAAATAGACACCAAATCT-3' | (SEQ ID NO: 137)<br>(SEQ ID NO: 521)<br>(SEQ ID NO: 905) |
| TTR-428 Target: | 5'-AAAGUGGAAAUAGACACCAAAUCtt-3'<br>3'-UGUUUCACCUUUAUCUGUGGUUUAGAA-5'<br>5'-ACAAAGTGGAAATAGACACCAAATCTT-3' | (SEQ ID NO: 138)<br>(SEQ ID NO: 522)<br>(SEQ ID NO: 906) |
| TTR-429 Target: | 5'-AAGUGGAAAUAGACACCAAAUCUta-3'<br>3'-GUUUCACCUUUAUCUGUGGUUUAGAAU-5'<br>5'-CAAAGTGGAAATAGACACCAAATCTTA-3' | (SEQ ID NO: 139)<br>(SEQ ID NO: 523)<br>(SEQ ID NO: 907) |
| TTR-430 Target: | 5'-AGUGGAAAUAGACACCAAAUCUUac-3'<br>3'-UUUCACCUUUAUCUGUGGUUUAGAAUG-5'<br>5'-AAAGTGGAAATAGACACCAAATCTTAC-3' | (SEQ ID NO: 140)<br>(SEQ ID NO: 524)<br>(SEQ ID NO: 908) |
| TTR-431 Target: | 5'-GUGGAAAUAGACACCAAAUCUUAct-3'<br>3'-UUCACCUUUAUCUGUGGUUUAGAAUGA-5'<br>5'-AAGTGGAAATAGACACCAAATCTTACT-3' | (SEQ ID NO: 141)<br>(SEQ ID NO: 525)<br>(SEQ ID NO: 909) |
| TTR-432 Target: | 5'-UGGAAAUAGACACCAAAUCUUACtg-3'<br>3'-UCACCUUUAUCUGUGGUUUAGAAUGAC-5'<br>5'-AGTGGAAATAGACACCAAATCTTACTG-3' | (SEQ ID NO: 142)<br>(SEQ ID NO: 526)<br>(SEQ ID NO: 910) |
| TTR-433 Target: | 5'-GGAAAUAGACACCAAAUCUUACUgg-3'<br>3'-CACCUUUAUCUGUGGUUUAGAAUGACC-5'<br>5'-GTGGAAATAGACACCAAATCTTACTGG-3' | (SEQ ID NO: 143)<br>(SEQ ID NO: 527)<br>(SEQ ID NO: 911) |
| TTR-434 Target: | 5'-GAAAUAGACACCAAAUCUUACUGga-3'<br>3'-ACCUUUAUCUGUGGUUUAGAAUGACCU-5'<br>5'-TGGAAATAGACACCAAATCTTACTGGA-3' | (SEQ ID NO: 144)<br>(SEQ ID NO: 528)<br>(SEQ ID NO: 912) |
| TTR-435 Target: | 5'-AAAUAGACACCAAAUCUUACUGGaa-3'<br>3'-CCUUUAUCUGUGGUUUAGAAUGACCUU-5'<br>5'-GGAAATAGACACCAAATCTTACTGGAA-3' | (SEQ ID NO: 145)<br>(SEQ ID NO: 529)<br>(SEQ ID NO: 913) |
| TTR-436 Target: | 5'-AAUAGACACCAAAUCUUACUGGAag-3'<br>3'-CUUUAUCUGUGGUUUAGAAUGACCUUC-5'<br>5'-GAAATAGACACCAAATCTTACTGGAAG-3' | (SEQ ID NO: 146)<br>(SEQ ID NO: 530)<br>(SEQ ID NO: 914) |
| TTR-437 Target: | 5'-AUAGACACCAAAUCUUACUGGAAgg-3'<br>3'-UUUAUCUGUGGUUUAGAAUGACCUUCC-5'<br>5'-AAATAGACACCAAATCTTACTGGAAGG-3' | (SEQ ID NO: 147)<br>(SEQ ID NO: 531)<br>(SEQ ID NO: 915) |
| TTR-439 Target: | 5'-AGACACCAAAUCUUACUGGAAGGca-3'<br>3'-UAUCUGUGGUUUAGAAUGACCUUCCGU-5'<br>5'-ATAGACACCAAATCTTACTGGAAGGCA-3' | (SEQ ID NO: 148)<br>(SEQ ID NO: 532)<br>(SEQ ID NO: 916) |
| TTR-440 Target: | 5'-GACACCAAAUCUUACUGGAAGGCac-3'<br>3'-AUCUGUGGUUUAGAAUGACCUUCCGUG-5'<br>5'-TAGACACCAAATCTTACTGGAAGGCAC-3' | (SEQ ID NO: 149)<br>(SEQ ID NO: 533)<br>(SEQ ID NO: 917) |
| TTR-462 Target: | 5'-CACUUGGCAUCUCCCCAUUCCAUga-3'<br>3'-CCGUGAACCGUAGAGGGGUAAGGUACU-5'<br>5'-GGCACTTGGCATCTCCCCATTCCATGA-3' | (SEQ ID NO: 150)<br>(SEQ ID NO: 534)<br>(SEQ ID NO: 918) |
| TTR-463 Target: | 5'-ACUUGGCAUCUCCCCAUUCCAUGag-3'<br>3'-CGUGAACCGUAGAGGGGUAAGGUACUC-5'<br>5'-GCACTTGGCATCTCCCCATTCCATGAG-3' | (SEQ ID NO: 151)<br>(SEQ ID NO: 535)<br>(SEQ ID NO: 919) |
| TTR-464 Target: | 5'-CUUGGCAUCUCCCCAUUCCAUGAgc-3'<br>3'-GUGAACCGUAGAGGGGUAAGGUACUCG-5'<br>5'-CACTTGGCATCTCCCCATTCCATGAGC-3' | (SEQ ID NO: 152)<br>(SEQ ID NO: 536)<br>(SEQ ID NO: 920) |
| TTR-465 Target: | 5'-UUGGCAUCUCCCCAUUCCAUGAGca-3'<br>3'-UGAACCGUAGAGGGGUAAGGUACUCGU-5'<br>5'-ACTTGGCATCTCCCCATTCCATGAGCA-3' | (SEQ ID NO: 153)<br>(SEQ ID NO: 537)<br>(SEQ ID NO: 921) |

TABLE 2-continued

Selected Human Anti-transthyretin DsiRNA Agents (Asymmetrics)

|              |                                                                                                                                          |                                                         |
|--------------|------------------------------------------------------------------------------------------------------------------------------------------|---------------------------------------------------------|
| TTR-466 Target: | 5'-UGGCAUCUCCCCAUUCCAUGAGCat-3'<br>3'-GAACCGUAGAGGGGUAAGGUACUCGUA-5'<br>5'-CTTGGCATCTCCCCATTCCATGAGCAT-3' | (SEQ ID NO: 154)<br>(SEQ ID NO: 538)<br>(SEQ ID NO: 922) |
| TTR-467 Target: | 5'-GGCAUCUCCCCAUUCCAUGAGCAtg-3'<br>3'-AACCGUAGAGGGGUAAGGUACUCGUAC-5'<br>5'-TTGGCATCTCCCCATTCCATGAGCATG-3' | (SEQ ID NO: 155)<br>(SEQ ID NO: 539)<br>(SEQ ID NO: 923) |
| TTR-468 Target: | 5'-GCAUCUCCCCAUUCCAUGAGCAUgc-3'<br>3'-ACCGUAGAGGGGUAAGGUACUCGUACG-5'<br>5'-TGGCATCTCCCCATTCCATGAGCATGC-3' | (SEQ ID NO: 156)<br>(SEQ ID NO: 540)<br>(SEQ ID NO: 924) |
| TTR-469 Target: | 5'-CAUCUCCCCAUUCCAUGAGCAUGca-3'<br>3'-CCGUAGAGGGGUAAGGUACUCGUACGU-5'<br>5'-GGCATCTCCCCATTCCATGAGCATGCA-3' | (SEQ ID NO: 157)<br>(SEQ ID NO: 541)<br>(SEQ ID NO: 925) |
| TTR-470 Target: | 5'-AUCUCCCCAUUCCAUGAGCAUGCag-3'<br>3'-CGUAGAGGGGUAAGGUACUCGUACGUC-5'<br>5'-GCATCTCCCCATTCCATGAGCATGCAG-3' | (SEQ ID NO: 158)<br>(SEQ ID NO: 542)<br>(SEQ ID NO: 926) |
| TTR-471 Target: | 5'-UCUCCCCAUUCCAUGAGCAUGCAga-3'<br>3'-GUAGAGGGGUAAGGUACUCGUACGUCU-5'<br>5'-CATCTCCCCATTCCATGAGCATGCAGA-3' | (SEQ ID NO: 159)<br>(SEQ ID NO: 543)<br>(SEQ ID NO: 927) |
| TTR-472 Target: | 5'-CUCCCCAUUCCAUGAGCAUGCAGag-3'<br>3'-UAGAGGGGUAAGGUACUCGUACGUCUC-5'<br>5'-ATCTCCCCATTCCATGAGCATGCAGAG-3' | (SEQ ID NO: 160)<br>(SEQ ID NO: 544)<br>(SEQ ID NO: 928) |
| TTR-473 Target: | 5'-UCCCCAUUCCAUGAGCAUGCAGAgg-3'<br>3'-AGAGGGGUAAGGUACUCGUACGUCUCC-5'<br>5'-TCTCCCCATTCCATGAGCATGCAGAGG-3' | (SEQ ID NO: 161)<br>(SEQ ID NO: 545)<br>(SEQ ID NO: 929) |
| TTR-474 Target: | 5'-CCCCAUUCCAUGAGCAUGCAGAGgt-3'<br>3'-GAGGGGUAAGGUACUCGUACGUCUCCA-5'<br>5'-CTCCCCATTCCATGAGCATGCAGAGGT-3' | (SEQ ID NO: 162)<br>(SEQ ID NO: 546)<br>(SEQ ID NO: 930) |
| TTR-482 Target: | 5'-CAUGAGCAUGCAGAGGUGGUAUUca-3'<br>3'-AGGUACUCGUACGUCUCCACCAUAAGU-5'<br>5'-TCCATGAGCATGCAGAGGTGGTATTCA-3' | (SEQ ID NO: 163)<br>(SEQ ID NO: 547)<br>(SEQ ID NO: 931) |
| TTR-483 Target: | 5'-AUGAGCAUGCAGAGGUGGUAUUCac-3'<br>3'-GGUACUCGUACGUCUCCACCAUAAGUG-5'<br>5'-CCATGAGCATGCAGAGGTGGTATTCAC-3' | (SEQ ID NO: 164)<br>(SEQ ID NO: 548)<br>(SEQ ID NO: 932) |
| TTR-484 Target: | 5'-UGAGCAUGCAGAGGUGGUAUUCAca-3'<br>3'-GUACUCGUACGUCUCCACCAUAAGUGU-5'<br>5'-CATGAGCATGCAGAGGTGGTATTCACA-3' | (SEQ ID NO: 165)<br>(SEQ ID NO: 549)<br>(SEQ ID NO: 933) |
| TTR-485 Target: | 5'-GAGCAUGCAGAGGUGGUAUUCACag-3'<br>3'-UACUCGUACGUCUCCACCAUAAGUGUC-5'<br>5'-ATGAGCATGCAGAGGTGGTATTCACAG-3' | (SEQ ID NO: 166)<br>(SEQ ID NO: 550)<br>(SEQ ID NO: 934) |
| TTR-489 Target: | 5'-AUGCAGAGGUGGUAUUCACAGCCaa-3'<br>3'-CGUACGUCUCCACCAUAAGUGUCGGUU-5'<br>5'-GCATGCAGAGGTGGTATTCACAGCCAA-3' | (SEQ ID NO: 167)<br>(SEQ ID NO: 551)<br>(SEQ ID NO: 935) |
| TTR-493 Target: | 5'-AGAGGUGGUAUUCACAGCCAACGac-3'<br>3'-CGUCUCCACCAUAAGUGUCGGUUGCUG-5'<br>5'-GCAGAGGTGGTATTCACAGCCAACGAC-3' | (SEQ ID NO: 168)<br>(SEQ ID NO: 552)<br>(SEQ ID NO: 936) |
| TTR-494 Target: | 5'-GAGGUGGUAUUCACAGCCAACGAct-3'<br>3'-GUCUCCACCAUAAGUGUCGGUUGCUGA-5'<br>5'-CAGAGGTGGTATTCACAGCCAACGACT-3' | (SEQ ID NO: 169)<br>(SEQ ID NO: 553)<br>(SEQ ID NO: 937) |
| TTR-581 Target: | 5'-GUCGUCACCAAUCCCAAGGAAUGag-3'<br>3'-GACAGCAGUGGUUAGGGUUCCUUACUC-5'<br>5'-CTGTCGTCACCAATCCCAAGGAATGAG-3' | (SEQ ID NO: 170)<br>(SEQ ID NO: 554)<br>(SEQ ID NO: 938) |
| TTR-631 Target: | 5'-GGACGAGGGAUGGGAUUUCAUGUaa-3'<br>3'-UUCCUGCUCCCUACCCUAAAGUACAUU-5'<br>5'-AAGGACGAGGGATGGGATTTCATGTAA-3' | (SEQ ID NO: 171)<br>(SEQ ID NO: 555)<br>(SEQ ID NO: 939) |
| TTR-632 Target: | 5'-GACGAGGGAUGGGAUUUCAUGUAac-3'<br>3'-UCCUGCUCCCUACCCUAAAGUACAUUG-5'<br>5'-AGGACGAGGGATGGGATTTCATGTAAC-3' | (SEQ ID NO: 172)<br>(SEQ ID NO: 556)<br>(SEQ ID NO: 940) |

TABLE 2-continued

Selected Human Anti-transthyretin DsiRNA Agents (Asymmetrics)

|  |  |  |
|---|---|---|
| TTR-635 Target: | 5'-GAGGGAUGGGAUUUCAUGUAACCaa-3'<br>3'-UGCUCCCUACCCUAAAGUACAUUGGUU-5'<br>5'-ACGAGGGATGGGATTTCATGTAACCAA-3' | (SEQ ID NO: 173)<br>(SEQ ID NO: 557)<br>(SEQ ID NO: 941) |
| TTR-636 Target: | 5'-AGGGAUGGGAUUUCAUGUAACCAag-3'<br>3'-GCUCCCUACCCUAAAGUACAUUGGUUC-5'<br>5'-CGAGGGATGGGATTTCATGTAACCAAG-3' | (SEQ ID NO: 174)<br>(SEQ ID NO: 558)<br>(SEQ ID NO: 942) |
| TTR-637 Target: | 5'-GGGAUGGGAUUUCAUGUAACCAAga-3'<br>3'-CUCCCUACCCUAAAGUACAUUGGUUCU-5'<br>5'-GAGGGATGGGATTTCATGTAACCAAGA-3' | (SEQ ID NO: 175)<br>(SEQ ID NO: 559)<br>(SEQ ID NO: 943) |
| TTR-639 Target: | 5'-GAUGGGAUUUCAUGUAACCAAGAgt-3'<br>3'-CCCUACCCUAAAGUACAUUGGUUCUCA-5'<br>5'-GGGATGGGATTTCATGTAACCAAGAGT-3' | (SEQ ID NO: 176)<br>(SEQ ID NO: 560)<br>(SEQ ID NO: 944) |
| TTR-640 Target: | 5'-AUGGGAUUUCAUGUAACCAAGAGta-3'<br>3'-CCUACCCUAAAGUACAUUGGUUCUCAU-5'<br>5'-GGATGGGATTTCATGTAACCAAGAGTA-3' | (SEQ ID NO: 177)<br>(SEQ ID NO: 561)<br>(SEQ ID NO: 945) |
| TTR-641 Target: | 5'-UGGGAUUUCAUGUAACCAAGAGUat-3'<br>3'-CUACCCUAAAGUACAUUGGUUCUCAUA-5'<br>5'-GATGGGATTTCATGTAACCAAGAGTAT-3' | (SEQ ID NO: 178)<br>(SEQ ID NO: 562)<br>(SEQ ID NO: 946) |
| TTR-642 Target: | 5'-GGGAUUUCAUGUAACCAAGAGUAtt-3'<br>3'-UACCCUAAAGUACAUUGGUUCUCAUAA-5'<br>5'-ATGGGATTTCATGTAACCAAGAGTATT-3' | (SEQ ID NO: 179)<br>(SEQ ID NO: 563)<br>(SEQ ID NO: 947) |
| TTR-643 Target: | 5'-GGAUUUCAUGUAACCAAGAGUAUtc-3'<br>3'-ACCCUAAAGUACAUUGGUUCUCAUAAG-5'<br>5'-TGGGATTTCATGTAACCAAGAGTATTC-3' | (SEQ ID NO: 180)<br>(SEQ ID NO: 564)<br>(SEQ ID NO: 948) |
| TTR-644 Target: | 5'-GAUUUCAUGUAACCAAGAGUAUUcc-3'<br>3'-CCCUAAAGUACAUUGGUUCUCAUAAGG-5'<br>5'-GGGATTTCATGTAACCAAGAGTATTCC-3' | (SEQ ID NO: 181)<br>(SEQ ID NO: 565)<br>(SEQ ID NO: 949) |
| TTR-645 Target: | 5'-AUUUCAUGUAACCAAGAGUAUUCca-3'<br>3'-CCUAAAGUACAUUGGUUCUCAUAAGGU-5'<br>5'-GGATTTCATGTAACCAAGAGTATTCCA-3' | (SEQ ID NO: 182)<br>(SEQ ID NO: 566)<br>(SEQ ID NO: 950) |
| TTR-646 Target: | 5'-UUUCAUGUAACCAAGAGUAUUCCat-3'<br>3'-CUAAAGUACAUUGGUUCUCAUAAGGUA-5'<br>5'-GATTTCATGTAACCAAGAGTATTCCAT-3' | (SEQ ID NO: 183)<br>(SEQ ID NO: 567)<br>(SEQ ID NO: 951) |
| TTR-647 Target: | 5'-UUCAUGUAACCAAGAGUAUUCCAtt-3'<br>3'-UAAAGUACAUUGGUUCUCAUAAGGUAA-5'<br>5'-ATTTCATGTAACCAAGAGTATTCCATT-3' | (SEQ ID NO: 184)<br>(SEQ ID NO: 568)<br>(SEQ ID NO: 952) |
| TTR-648 Target: | 5'-UCAUGUAACCAAGAGUAUUCCAUtt-3'<br>3'-AAAGUACAUUGGUUCUCAUAAGGUAAA-5'<br>5'-TTTCATGTAACCAAGAGTATTCCATTT-3' | (SEQ ID NO: 185)<br>(SEQ ID NO: 569)<br>(SEQ ID NO: 953) |
| TTR-649 Target: | 5'-CAUGUAACCAAGAGUAUUCCAUUtt-3'<br>3'-AAGUACAUUGGUUCUCAUAAGGUAAAA-5'<br>5'-TTCATGTAACCAAGAGTATTCCATTTT-3' | (SEQ ID NO: 186)<br>(SEQ ID NO: 570)<br>(SEQ ID NO: 954) |
| TTR-650 Target: | 5'-AUGUAACCAAGAGUAUUCCAUUUtt-3'<br>3'-AGUACAUUGGUUCUCAUAAGGUAAAAA-5'<br>5'-TCATGTAACCAAGAGTATTCCATTTTT-3' | (SEQ ID NO: 187)<br>(SEQ ID NO: 571)<br>(SEQ ID NO: 955) |
| TTR-651 Target: | 5'-UGUAACCAAGAGUAUUCCAUUUUta-3'<br>3'-GUACAUUGGUUCUCAUAAGGUAAAAAU-5'<br>5'-CATGTAACCAAGAGTATTCCATTTTTA-3' | (SEQ ID NO: 188)<br>(SEQ ID NO: 572)<br>(SEQ ID NO: 956) |
| TTR-652 Target: | 5'-GUAACCAAGAGUAUUCCAUUUUUac-3'<br>3'-UACAUUGGUUCUCAUAAGGUAAAAAUG-5'<br>5'-ATGTAACCAAGAGTATTCCATTTTTAC-3' | (SEQ ID NO: 189)<br>(SEQ ID NO: 573)<br>(SEQ ID NO: 957) |
| TTR-653 Target: | 5'-UAACCAAGAGUAUUCCAUUUUUAct-3'<br>3'-ACAUUGGUUCUCAUAAGGUAAAAAUGA-5'<br>5'-TGTAACCAAGAGTATTCCATTTTTACT-3' | (SEQ ID NO: 190)<br>(SEQ ID NO: 574)<br>(SEQ ID NO: 958) |
| TTR-654 Target: | 5'-AACCAAGAGUAUUCCAUUUUUACta-3'<br>3'-CAUUGGUUCUCAUAAGGUAAAAAUGAU-5'<br>5'-GTAACCAAGAGTATTCCATTTTTACTA-3' | (SEQ ID NO: 191)<br>(SEQ ID NO: 575)<br>(SEQ ID NO: 959) |

TABLE 2-continued

Selected Human Anti-transthyretin DsiRNA Agents (Asymmetrics)

| | | |
|---|---|---|
| TTR-655 Target: | 5'-ACCAAGAGUAUUCCAUUUUUACUaa-3'<br>3'-AUUGGUUCUCAUAAGGUAAAAAUGAUU-5'<br>5'-TAACCAAGAGTATTCCATTTTTACTAA-3' | (SEQ ID NO: 192)<br>(SEQ ID NO: 576)<br>(SEQ ID NO: 960) |
| TTR-656 Target: | 5'-CCAAGAGUAUUCCAUUUUUACUAaa-3'<br>3'-UUGGUUCUCAUAAGGUAAAAAUGAUUU-5'<br>5'-AACCAAGAGTATTCCATTTTTACTAAA-3' | (SEQ ID NO: 193)<br>(SEQ ID NO: 577)<br>(SEQ ID NO: 961) |
| TTR-657 Target: | 5'-CAAGAGUAUUCCAUUUUUACUAAag-3'<br>3'-UGGUUCUCAUAAGGUAAAAAUGAUUUC-5'<br>5'-ACCAAGAGTATTCCATTTTTACTAAAG-3' | (SEQ ID NO: 194)<br>(SEQ ID NO: 578)<br>(SEQ ID NO: 962) |
| TTR-658 Target: | 5'-AAGAGUAUUCCAUUUUUACUAAAgc-3'<br>3'-GGUUCUCAUAAGGUAAAAAUGAUUUCG-5'<br>5'-CCAAGAGTATTCCATTTTTACTAAAGC-3' | (SEQ ID NO: 195)<br>(SEQ ID NO: 579)<br>(SEQ ID NO: 963) |
| TTR-659 Target: | 5'-AGAGUAUUCCAUUUUUACUAAAGca-3'<br>3'-GUUCUCAUAAGGUAAAAAUGAUUUCGU-5'<br>5'-CAAGAGTATTCCATTTTTACTAAAGCA-3' | (SEQ ID NO: 196)<br>(SEQ ID NO: 580)<br>(SEQ ID NO: 964) |
| TTR-660 Target: | 5'-GAGUAUUCCAUUUUUACUAAAGCag-3'<br>3'-UUCUCAUAAGGUAAAAAUGAUUUCGUC-5'<br>5'-AAGAGTATTCCATTTTTACTAAAGCAG-3' | (SEQ ID NO: 197)<br>(SEQ ID NO: 581)<br>(SEQ ID NO: 965) |
| TTR-661 Target: | 5'-AGUAUUCCAUUUUUACUAAAGCAgt-3'<br>3'-UCUCAUAAGGUAAAAAUGAUUUCGUCA-5'<br>5'-AGAGTATTCCATTTTTACTAAAGCAGT-3' | (SEQ ID NO: 198)<br>(SEQ ID NO: 582)<br>(SEQ ID NO: 966) |
| TTR-662 Target: | 5'-GUAUUCCAUUUUUACUAAAGCAGtg-3'<br>3'-CUCAUAAGGUAAAAAUGAUUUCGUCAC-5'<br>5'-GAGTATTCCATTTTTACTAAAGCAGTG-3' | (SEQ ID NO: 199)<br>(SEQ ID NO: 583)<br>(SEQ ID NO: 967) |
| TTR-663 Target: | 5'-UAUUCCAUUUUUACUAAAGCAGUgt-3'<br>3'-UCAUAAGGUAAAAAUGAUUUCGUCACA-5'<br>5'-AGTATTCCATTTTTACTAAAGCAGTGT-3' | (SEQ ID NO: 200)<br>(SEQ ID NO: 584)<br>(SEQ ID NO: 968) |
| TTR-664 Target: | 5'-AUUCCAUUUUUACUAAAGCAGUGtt-3'<br>3'-CAUAAGGUAAAAAUGAUUUCGUCACAA-5'<br>5'-GTATTCCATTTTTACTAAAGCAGTGTT-3' | (SEQ ID NO: 201)<br>(SEQ ID NO: 585)<br>(SEQ ID NO: 969) |
| TTR-665 Target: | 5'-UUCCAUUUUUACUAAAGCAGUGUtt-3'<br>3'-AUAAGGUAAAAAUGAUUUCGUCACAAA-5'<br>5'-TATTCCATTTTTACTAAAGCAGTGTTT-3' | (SEQ ID NO: 202)<br>(SEQ ID NO: 586)<br>(SEQ ID NO: 970) |
| TTR-666 Target: | 5'-UCCAUUUUUACUAAAGCAGUGUUtt-3'<br>3'-UAAGGUAAAAAUGAUUUCGUCACAAAA-5'<br>5'-ATTCCATTTTTACTAAAGCAGTGTTTT-3' | (SEQ ID NO: 203)<br>(SEQ ID NO: 587)<br>(SEQ ID NO: 971) |
| TTR-667 Target: | 5'-CCAUUUUUACUAAAGCAGUGUUUtc-3'<br>3'-AAGGUAAAAAUGAUUUCGUCACAAAAG-5'<br>5'-TTCCATTTTTACTAAAGCAGTGTTTTC-3' | (SEQ ID NO: 204)<br>(SEQ ID NO: 588)<br>(SEQ ID NO: 972) |
| TTR-668 Target: | 5'-CAUUUUUACUAAAGCAGUGUUUUca-3'<br>3'-AGGUAAAAAUGAUUUCGUCACAAAAGU-5'<br>5'-TCCATTTTTACTAAAGCAGTGTTTTCA-3' | (SEQ ID NO: 205)<br>(SEQ ID NO: 589)<br>(SEQ ID NO: 973) |
| TTR-669 Target: | 5'-AUUUUUACUAAAGCAGUGUUUUCac-3'<br>3'-GGUAAAAAUGAUUUCGUCACAAAAGUG-5'<br>5'-CCATTTTTACTAAAGCAGTGTTTTCAC-3' | (SEQ ID NO: 206)<br>(SEQ ID NO: 590)<br>(SEQ ID NO: 974) |
| TTR-670 Target: | 5'-UUUUUACUAAAGCAGUGUUUUCAcc-3'<br>3'-GUAAAAAUGAUUUCGUCACAAAAGUGG-5'<br>5'-CATTTTTACTAAAGCAGTGTTTTCACC-3' | (SEQ ID NO: 207)<br>(SEQ ID NO: 591)<br>(SEQ ID NO: 975) |
| TTR-671 Target: | 5'-UUUUACUAAAGCAGUGUUUUCACct-3'<br>3'-UAAAAAUGAUUUCGUCACAAAAGUGGA-5'<br>5'-ATTTTTACTAAAGCAGTGTTTTCACCT-3' | (SEQ ID NO: 208)<br>(SEQ ID NO: 592)<br>(SEQ ID NO: 976) |
| TTR-672 Target: | 5'-UUUACUAAAGCAGUGUUUUCACCtc-3'<br>3'-AAAAAUGAUUUCGUCACAAAAGUGGAG-5'<br>5'-TTTTTACTAAAGCAGTGTTTTCACCTC-3' | (SEQ ID NO: 209)<br>(SEQ ID NO: 593)<br>(SEQ ID NO: 977) |
| TTR-673 Target: | 5'-UUACUAAAGCAGUGUUUUCACCUca-3'<br>3'-AAAAUGAUUUCGUCACAAAAGUGGAGU-5'<br>5'-TTTTACTAAAGCAGTGTTTTCACCTCA-3' | (SEQ ID NO: 210)<br>(SEQ ID NO: 594)<br>(SEQ ID NO: 978) |

TABLE 2-continued

Selected Human Anti-transthyretin DsiRNA Agents (Asymmetrics)

| | | |
|---|---|---|
| TTR-674 | 5'-U<u>A</u>C<u>U</u>AAAGCAGUGU<u>UU</u>UCACCUCat-3'<br>3'-<u>AAAU</u>G<u>A</u>UUUCGUC<u>AC</u>AAAAGUGG<u>A</u>GUA-5'<br>Target: 5'-TTTACTAAAGCAGTGTTTTCACCTCAT-3' | (SEQ ID NO: 211)<br>(SEQ ID NO: 595)<br>(SEQ ID NO: 979) |
| TTR-675 | 5'-<u>A</u>C<u>U</u>AAAGCAGUGU<u>UUU</u>CACCUCAta-3'<br>3'-<u>AAU</u>G<u>A</u>UUUCGUCAC<u>A</u>AAAGUGGAGU<u>AU</u>-5'<br>Target: 5'-TTACTAAAGCAGTGTTTTCACCTCATA-3' | (SEQ ID NO: 212)<br>(SEQ ID NO: 596)<br>(SEQ ID NO: 980) |
| TTR-676 | 5'-C<u>U</u>AAAGCAGUGU<u>UUU</u>CACCUCA<u>U</u>at-3'<br>3'-<u>A</u>UG<u>A</u>UUUCGUCACA<u>AAA</u>GUGGAGU<u>AUA</u>-5'<br>Target: 5'-TACTAAAGCAGTGTTTTCACCTCATAT-3' | (SEQ ID NO: 213)<br>(SEQ ID NO: 597)<br>(SEQ ID NO: 981) |
| TTR-677 | 5'-U<u>AAA</u>GCAGUGUUU<u>U</u>C<u>A</u>CCUCAUAtg-3'<br>3'-<u>U</u>G<u>A</u>UUUCGUCACAAA<u>A</u>GUGGAGU<u>AUAC</u>-5'<br>Target: 5'-ACTAAAGCAGTGTTTTCACCTCATATG-3' | (SEQ ID NO: 214)<br>(SEQ ID NO: 598)<br>(SEQ ID NO: 982) |
| TTR-678 | 5'-A<u>AA</u>GCAGUGUUUUC<u>A</u>CCUCAU<u>A</u>Ugc-3'<br>3'-<u>GA</u>UU<u>U</u>CGUCACAAA<u>A</u>GUGGAGU<u>AUA</u>CG-5'<br>Target: 5'-CTAAAGCAGTGTTTTCACCTCATATGC-3' | (SEQ ID NO: 215)<br>(SEQ ID NO: 599)<br>(SEQ ID NO: 983) |
| TTR-679 | 5'-A<u>A</u>GCAGUGUUUUC<u>A</u>CCUCAUAUGct-3'<br>3'-<u>A</u>UUU<u>C</u>GUCACAAA<u>A</u>G<u>U</u>GGAGUAU<u>AC</u>GA-5'<br>Target: 5'-TAAAGCAGTGTTTTCACCTCATATGCT-3' | (SEQ ID NO: 216)<br>(SEQ ID NO: 600)<br>(SEQ ID NO: 984) |
| TTR-680 | 5'-<u>A</u>GCAGUGUUUUC<u>A</u>C<u>CU</u>CAUAUGCta-3'<br>3'-<u>UUU</u>C<u>G</u>UCACAAAAG<u>U</u>GGAGUAUA<u>C</u>GAU-5'<br>Target: 5'-AAAGCAGTGTTTTCACCTCATATGCTA-3' | (SEQ ID NO: 217)<br>(SEQ ID NO: 601)<br>(SEQ ID NO: 985) |
| TTR-681 | 5'-GC<u>A</u>GUGUUUUCACC<u>U</u>C<u>A</u>UAUGC<u>U</u>at-3'<br>3'-<u>UUCG</u>UCACAAAAGUGG<u>A</u>GUAUAC<u>G</u>AUA-5'<br>Target: 5'-AAGCAGTGTTTTCACCTCATATGCTAT-3' | (SEQ ID NO: 218)<br>(SEQ ID NO: 602)<br>(SEQ ID NO: 986) |
| TTR-682 | 5'-C<u>A</u>GUGUUUUCACC<u>U</u>CAUAUGCUAtg-3'<br>3'-<u>UCGU</u>CACAAAAGUGG<u>A</u>GUAUACG<u>A</u>UAC-5'<br>Target: 5'-AGCAGTGTTTTCACCTCATATGCTATG-3' | (SEQ ID NO: 219)<br>(SEQ ID NO: 603)<br>(SEQ ID NO: 987) |
| TTR-683 | 5'-A<u>GU</u>GUUUUCACCUC<u>A</u>UAUGCUAUgt-3'<br>3'-<u>CGUC</u><u>A</u>CAAAAGUGG<u>A</u>GUAUACG<u>A</u>U<u>A</u>CA-5'<br>Target: 5'-GCAGTGTTTTCACCTCATATGCTATGT-3' | (SEQ ID NO: 220)<br>(SEQ ID NO: 604)<br>(SEQ ID NO: 988) |
| TTR-684 | 5'-G<u>U</u>GUUUUCACCUC<u>A</u>U<u>A</u>UGCUAUGtt-3'<br>3'-<u>GUCA</u>CAAAAGUGGAG<u>U</u>AUACGAU<u>A</u>CAA-5'<br>Target: 5'-CAGTGTTTTCACCTCATATGCTATGTT-3' | (SEQ ID NO: 221)<br>(SEQ ID NO: 605)<br>(SEQ ID NO: 989) |
| TTR-685 | 5'-U<u>G</u>UUUUCACCUC<u>A</u>U<u>A</u>UGCUAUGUta-3'<br>3'-<u>UCAC</u>AAAAGUGGAGU<u>A</u>UACGAUAC<u>A</u>AU-5'<br>Target: 5'-AGTGTTTTCACCTCATATGCTATGTTA-3' | (SEQ ID NO: 222)<br>(SEQ ID NO: 606)<br>(SEQ ID NO: 990) |
| TTR-686 | 5'-GUUU<u>U</u>CACCUCAU<u>A</u>UGCUAUGUUag-3'<br>3'-<u>CAC</u>AAAAGUGGAGUA<u>U</u>ACGAUACAAUC-5'<br>Target: 5'-GTGTTTTCACCTCATATGCTATGTTAG-3' | (SEQ ID NO: 223)<br>(SEQ ID NO: 607)<br>(SEQ ID NO: 991) |
| TTR-687 | 5'-U<u>UUU</u>CACCUCAU<u>A</u>UGC<u>U</u>AUGUUAga-3'<br>3'-<u>AC</u>AAAAGUGGAGUA<u>UA</u>CGAUACA<u>A</u>UCU-5'<br>Target: 5'-TGTTTTCACCTCATATGCTATGTTAGA-3' | (SEQ ID NO: 224)<br>(SEQ ID NO: 608)<br>(SEQ ID NO: 992) |
| TTR-688 | 5'-U<u>UU</u>CACCUCAU<u>A</u>UGC<u>U</u>AUGUUAGaa-3'<br>3'-<u>C</u>AAAAGUGGAGUAU<u>A</u>CGAUACAAUCUU-5'<br>Target: 5'-GTTTTCACCTCATATGCTATGTTAGAA-3' | (SEQ ID NO: 225)<br>(SEQ ID NO: 609)<br>(SEQ ID NO: 993) |
| TTR-689 | 5'-U<u>U</u>C<u>A</u>CCUCAUAUGC<u>U</u>AUGUUAGag-3'<br>3'-<u>AAAA</u>GUGGAGUAUAC<u>G</u>AUACAAUC<u>UUC</u>-5'<br>Target: 5'-TTTTCACCTCATATGCTATGTTAGAAG-3' | (SEQ ID NO: 226)<br>(SEQ ID NO: 610)<br>(SEQ ID NO: 994) |
| TTR-690 | 5'-UC<u>A</u>CCUCAUAUGC<u>U</u>AUGUUAGAAgt-3'<br>3'-<u>AAA</u>GUGGAGUAUAC<u>G</u>AUACAAUC<u>UUCA</u>-5'<br>Target: 5'-TTTCACCTCATATGCTATGTTAGAAGT-3' | (SEQ ID NO: 227)<br>(SEQ ID NO: 611)<br>(SEQ ID NO: 995) |
| TTR-691 | 5'-C<u>AC</u>CUCAUAUGCU<u>A</u>UGUUAGAAGtc-3'<br>3'-<u>AA</u>GUGGAGUAUACG<u>A</u>UACAAUCUUCAG-5'<br>Target: 5'-TTCACCTCATATGCTATGTTAGAAGTC-3' | (SEQ ID NO: 228)<br>(SEQ ID NO: 612)<br>(SEQ ID NO: 996) |
| TTR-692 | 5'-A<u>CC</u>UCAUAUGCU<u>A</u>UGUUAGAAGUcc-3'<br>3'-<u>A</u>GUGGAGUAUACG<u>A</u>UACAAUCU<u>U</u>CAGG-5'<br>Target: 5'-TCACCTCATATGCTATGTTAGAAGTCC-3' | (SEQ ID NO: 229)<br>(SEQ ID NO: 613)<br>(SEQ ID NO: 997) |

TABLE 2-continued

Selected Human Anti-transthyretin DsiRNA Agents (Asymmetrics)

|  |  |  |
|---|---|---|
| TTR-693 Target: | 5'-<u>CCU</u>CAUAUGCUAUG<u>UU</u>AGAAGUCca-3'<br>3'-<u>GUGGAGUAUACGAUAC</u>AAUCUUC<u>AGGU</u>-5'<br>5'-CACCTCATATGCTATGTTAGAAGTCCA-3' | (SEQ ID NO: 230)<br>(SEQ ID NO: 614)<br>(SEQ ID NO: 998) |
| TTR-694 Target: | 5'-<u>CUC</u>AUAUGCUAUGU<u>U</u>AGAAGUCCag-3'<br>3'-<u>UGG</u>AGUAUACGAUAC<u>A</u>AUCUUC<u>AGGUC</u>-5'<br>5'-ACCTCATATGCTATGTTAGAAGTCCAG-3' | (SEQ ID NO: 231)<br>(SEQ ID NO: 615)<br>(SEQ ID NO: 999) |
| TTR-695 Target: | 5'-<u>UC</u>AUAUGCUAUGUU<u>A</u>G<u>A</u>AGUCCAgg-3'<br>3'-<u>GGA</u>GUAUACGAUAC<u>A</u>AUCUUCAGG<u>UCC</u>-5'<br>5'-CCTCATATGCTATGTTAGAAGTCCAGG-3' | (SEQ ID NO: 232)<br>(SEQ ID NO: 616)<br>(SEQ ID NO: 1000) |
| TTR-696 Target: | 5'-<u>C</u>A<u>U</u>AUGCUAUGUUAG<u>A</u>AGUCCAGgc-3'<br>3'-<u>GA</u>G<u>UAUACGAUACA</u>AUCUUCAGG<u>UCCG</u>-5'<br>5'-CTCATATGCTATGTTAGAAGTCCAGGC-3' | (SEQ ID NO: 233)<br>(SEQ ID NO: 617)<br>(SEQ ID NO: 1001) |
| TTR-697 Target: | 5'-<u>AUAU</u>GCUAUGUU<u>A</u>G<u>A</u>AGUCCAGGca-3'<br>3'-<u>AGUA</u>UACGAUAC<u>AAUCUU</u>CAGGU<u>CCGU</u>-5'<br>5'-TCATATGCTATGTTAGAAGTCCAGGCA-3' | (SEQ ID NO: 234)<br>(SEQ ID NO: 618)<br>(SEQ ID NO: 1002) |
| TTR-698 Target: | 5'-<u>U</u>A<u>U</u>GCUAUGUUAG<u>AA</u>GUCCAGGCag-3'<br>3'-<u>G</u>U<u>A</u>UACGAUACAAUC<u>UU</u>CAGGUCC<u>GUC</u>-5'<br>5'-CATATGCTATGTTAGAAGTCCAGGCAG-3' | (SEQ ID NO: 235)<br>(SEQ ID NO: 619)<br>(SEQ ID NO: 1003) |
| TTR-699 Target: | 5'-<u>AU</u>GCUAUGUUAGA<u>A</u>GU<u>CC</u>AGGCAga-3'<br>3'-<u>UAUA</u>CGAUACAAUC<u>UU</u>CAGGUCC<u>GUCU</u>-5'<br>5'-ATATGCTATGTTAGAAGTCCAGGCAGA-3' | (SEQ ID NO: 236)<br>(SEQ ID NO: 620)<br>(SEQ ID NO: 1004) |
| TTR-702 Target: | 5'-<u>C</u>UAUGUUAGAAGU<u>CC</u>AGGCAGAgac-3'<br>3'-<u>AC</u>G<u>AUACAAUCUUC</u>A<u>GG</u>UCCGUC<u>UCUG</u>-5'<br>5'-TGCTATGTTAGAAGTCCAGGCAGAGAC-3' | (SEQ ID NO: 237)<br>(SEQ ID NO: 621)<br>(SEQ ID NO: 1005) |
| TTR-704 Target: | 5'-<u>A</u>UGUUAGAAGUCC<u>A</u>GGCAGAGACaa-3'<br>3'-<u>GAUA</u>CAAUCUUCAGGU<u>CC</u>GUCUC<u>UGUU</u>-5'<br>5'-CTATGTTAGAAGTCCAGGCAGAGACAA-3' | (SEQ ID NO: 238)<br>(SEQ ID NO: 622)<br>(SEQ ID NO: 1006) |
| TTR-705 Target: | 5'-<u>U</u>G<u>UU</u>AGAAGUCCAG<u>GC</u>AGAGACAat-3'<br>3'-<u>AUAC</u>AAUCUUCAGGU<u>CC</u>GUCUC<u>UGUUA</u>-5'<br>5'-TATGTTAGAAGTCCAGGCAGAGACAAT-3' | (SEQ ID NO: 239)<br>(SEQ ID NO: 623)<br>(SEQ ID NO: 1007) |
| TTR-706 Target: | 5'-<u>GUU</u>AGAAGUCCAGG<u>C</u>AGAGACAAta-3'<br>3'-<u>UACA</u>AUCUUCAGGU<u>CC</u>GUCUCUG<u>UUAU</u>-5'<br>5'-ATGTTAGAAGTCCAGGCAGAGACAATA-3' | (SEQ ID NO: 240)<br>(SEQ ID NO: 624)<br>(SEQ ID NO: 1008) |
| TTR-707 Target: | 5'-<u>UU</u>AGAAGUCCAGGC<u>A</u>GAGACAAUaa-3'<br>3'-<u>AC</u>AAUCUUCAGGUCC<u>GU</u>CUCUGU<u>UAUU</u>-5'<br>5'-TGTTAGAAGTCCAGGCAGAGACAATAA-3' | (SEQ ID NO: 241)<br>(SEQ ID NO: 625)<br>(SEQ ID NO: 1009) |
| TTR-708 Target: | 5'-<u>U</u>A<u>G</u>AAGUCCAGGCA<u>G</u>A<u>G</u>ACAAUAaa-3'<br>3'-<u>CAA</u>UCUUCAGGUCC<u>GU</u>CUCUGUU<u>AUUU</u>-5'<br>5'-GTTAGAAGTCCAGGCAGAGACAATAAA-3' | (SEQ ID NO: 242)<br>(SEQ ID NO: 626)<br>(SEQ ID NO: 1010) |
| TTR-709 Target: | 5'-<u>A</u>G<u>A</u>AGUCCAGGCA<u>G</u>A<u>G</u>ACAAUAAaa-3'<br>3'-<u>AA</u>UCUUCAGGUCCGU<u>C</u>UCUGUU<u>AUUUU</u>-5'<br>5'-TTAGAAGTCCAGGCAGAGACAATAAAA-3' | (SEQ ID NO: 243)<br>(SEQ ID NO: 627)<br>(SEQ ID NO: 1011) |
| TTR-710 Target: | 5'-<u>G</u>A<u>A</u>GUCCAGGCAGA<u>GA</u>CAAUAAAac-3'<br>3'-<u>A</u>U<u>C</u>UUCAGGUCCGUC<u>U</u>CUGUUA<u>UUUG</u>-5'<br>5'-TAGAAGTCCAGGCAGAGACAATAAAAC-3' | (SEQ ID NO: 244)<br>(SEQ ID NO: 628)<br>(SEQ ID NO: 1012) |
| TTR-711 Target: | 5'-<u>AAGU</u>CCAGGCAGAGA<u>C</u>AAUAAAAca-3'<br>3'-<u>UC</u>UUCAGGUCCGUC<u>UC</u>UGUUAU<u>UUGU</u>-5'<br>5'-AGAAGTCCAGGCAGAGACAATAAAACA-3' | (SEQ ID NO: 245)<br>(SEQ ID NO: 629)<br>(SEQ ID NO: 1013) |
| TTR-712 Target: | 5'-<u>A</u>G<u>U</u>CCAGGCAGAGAC<u>AA</u>UAAAACat-3'<br>3'-<u>CUU</u>CAGGUCCGUCU<u>C</u>UGUUAUU<u>UGUA</u>-5'<br>5'-GAAGTCCAGGCAGAGACAATAAAACAT-3' | (SEQ ID NO: 246)<br>(SEQ ID NO: 630)<br>(SEQ ID NO: 1014) |
| TTR-713 Target: | 5'-<u>G</u>U<u>CC</u>AGGCAGAGAC<u>A</u>A<u>U</u>AAAACAtt-3'<br>3'-<u>UUC</u>AGGUCCGUCUCUGUUAUUU<u>GUAA</u>-5'<br>5'-AAGTCCAGGCAGAGACAATAAAACATT-3' | (SEQ ID NO: 247)<br>(SEQ ID NO: 631)<br>(SEQ ID NO: 1015) |
| TTR-714 Target: | 5'-<u>U</u>CC<u>A</u>GGCAGAGAC<u>A</u>A<u>U</u>AAAACAUtc-3'<br>3'-<u>UCAGG</u>UCCGUCUCUG<u>U</u>UAUUUUG<u>UAAG</u>-5'<br>5'-AGTCCAGGCAGAGACAATAAAACATTC-3' | (SEQ ID NO: 248)<br>(SEQ ID NO: 632)<br>(SEQ ID NO: 1016) |

TABLE 2-continued

Selected Human Anti-transthyretin DsiRNA Agents (Asymmetrics)

| | | |
|---|---|---|
| TTR-716 Target: | 5'-CAGGCAGAGACAAUAAAACAUUCct-3'<br>3'-AGGUCCGUCUCUGUUAUUUUGUAAGGA-5'<br>5'-TCCAGGCAGAGACAATAAAACATTCCT-3' | (SEQ ID NO: 249)<br>(SEQ ID NO: 633)<br>(SEQ ID NO: 1017) |
| TTR-717 Target: | 5'-AGGCAGAGACAAUAAAACAUUCCtg-3'<br>3'-GGUCCGUCUCUGUUAUUUUGUAAGGAC-5'<br>5'-CCAGGCAGAGACAATAAAACATTCCTG-3' | (SEQ ID NO: 250)<br>(SEQ ID NO: 634)<br>(SEQ ID NO: 1018) |
| TTR-718 Target: | 5'-GGCAGAGACAAUAAAACAUUCCUgt-3'<br>3'-GUCCGUCUCUGUUAUUUUGUAAGGACA-5'<br>5'-CAGGCAGAGACAATAAAACATTCCTGT-3' | (SEQ ID NO: 251)<br>(SEQ ID NO: 635)<br>(SEQ ID NO: 1019) |
| TTR-719 Target: | 5'-GCAGAGACAAUAAAACAUUCCUgt-3'<br>3'-UCCGUCUCUGUUAUUUUGUAAGGACAC-5'<br>5'-AGGCAGAGACAATAAAACATTCCTGTG-3' | (SEQ ID NO: 252)<br>(SEQ ID NO: 636)<br>(SEQ ID NO: 1020) |
| TTR-720 Target: | 5'-CAGAGACAAUAAAACAUUCCUGUga-3'<br>3'-CCGUCUCUGUUAUUUUGUAAGGACACU-5'<br>5'-GGCAGAGACAATAAAACATTCCTGTGA-3' | (SEQ ID NO: 253)<br>(SEQ ID NO: 637)<br>(SEQ ID NO: 1021) |
| TTR-721 Target: | 5'-AGAGACAAUAAAACAUUCCUGUGaa-3'<br>3'-CGUCUCUGUUAUUUUGUAAGGACACUU-5'<br>5'-GCAGAGACAATAAAACATTCCTGTGAA-3' | (SEQ ID NO: 254)<br>(SEQ ID NO: 638)<br>(SEQ ID NO: 1022) |
| TTR-722 Target: | 5'-GAGACAAUAAAACAUUCCUGUGAaa-3'<br>3'-GUCUCUGUUAUUUUGUAAGGACACUUU-5'<br>5'-CAGAGACAATAAAACATTCCTGTGAAA-3' | (SEQ ID NO: 255)<br>(SEQ ID NO: 639)<br>(SEQ ID NO: 1023) |
| TTR-723 Target: | 5'-AGACAAUAAAACAUUCCUGUGAAag-3'<br>3'-UCUCUGUUAUUUUGUAAGGACACUUUC-5'<br>5'-AGAGACAATAAAACATTCCTGTGAAAG-3' | (SEQ ID NO: 256)<br>(SEQ ID NO: 640)<br>(SEQ ID NO: 1024) |
| TTR-724 Target: | 5'-GACAAUAAAACAUUCCUGUGAAAgg-3'<br>3'-CUCUGUUAUUUUGUAAGGACACUUUCC-5'<br>5'-GAGACAATAAAACATTCCTGTGAAAGG-3' | (SEQ ID NO: 257)<br>(SEQ ID NO: 641)<br>(SEQ ID NO: 1025) |
| TTR-725 Target: | 5'-ACAAUAAAACAUUCCUGUGAAAGgc-3'<br>3'-UCUGUUAUUUUGUAAGGACACUUUCCG-5'<br>5'-AGACAATAAAACATTCCTGTGAAAGGC-3' | (SEQ ID NO: 258)<br>(SEQ ID NO: 642)<br>(SEQ ID NO: 1026) |
| TTR-726 Target: | 5'-CAAUAAAACAUUCCUGUGAAAGGca-3'<br>3'-CUGUUAUUUUGUAAGGACACUUUCCGU-5'<br>5'-GACAATAAAACATTCCTGTGAAAGGCA-3' | (SEQ ID NO: 259)<br>(SEQ ID NO: 643)<br>(SEQ ID NO: 1027) |
| TTR-727 Target: | 5'-AAUAAAACAUUCCUGUGAAAGGCac-3'<br>3'-UGUUAUUUUGUAAGGACACUUUCCGUG-5'<br>5'-ACAATAAAACATTCCTGTGAAAGGCAC-3' | (SEQ ID NO: 260)<br>(SEQ ID NO: 644)<br>(SEQ ID NO: 1028) |
| TTR-728 Target: | 5'-AUAAAACAUUCCUGUGAAAGGCAct-3'<br>3'-GUUAUUUUGUAAGGACACUUUCCGUGA-5'<br>5'-CAATAAAACATTCCTGTGAAAGGCACT-3' | (SEQ ID NO: 261)<br>(SEQ ID NO: 645)<br>(SEQ ID NO: 1029) |
| TTR-731 Target: | 5'-AAACAUUCCUGUGAAAGGCACUtt-3'<br>3'-AUUUUGUAAGGACACUUUCCGUGAAAA-5'<br>5'-TAAAACATTCCTGTGAAAGGCACTTTT-3' | (SEQ ID NO: 262)<br>(SEQ ID NO: 646)<br>(SEQ ID NO: 1030) |
| TTR-732 Target: | 5'-AACAUUCCUGUGAAAGGCACUUUtc-3'<br>3'-UUUUGUAAGGACACUUUCCGUGAAAAG-5'<br>5'-AAAACATTCCTGTGAAAGGCACTTTTC-3' | (SEQ ID NO: 263)<br>(SEQ ID NO: 647)<br>(SEQ ID NO: 1031) |
| TTR-733 Target: | 5'-ACAUUCCUGUGAAAGGCACUUUUca-3'<br>3'-UUUGUAAGGACACUUUCCGUGAAAAGU-5'<br>5'-AAACATTCCTGTGAAAGGCACTTTTCA-3' | (SEQ ID NO: 264)<br>(SEQ ID NO: 648)<br>(SEQ ID NO: 1032) |
| TTR-734 Target: | 5'-CAUUCCUGUGAAAGGCACUUUUCat-3'<br>3'-UGUAAGGACACUUUCCGUGAAAAGUA-5'<br>5'-AACATTCCTGTGAAAGGCACTTTTCAT-3' | (SEQ ID NO: 265)<br>(SEQ ID NO: 649)<br>(SEQ ID NO: 1033) |
| TTR-735 Target: | 5'-AUUCCUGUGAAAGGCACUUUUCAtt-3'<br>3'-UGUAAGGACACUUUCCGUGAAAAGUAA-5'<br>5'-ACATTCCTGTGAAAGGCACTTTTCATT-3' | (SEQ ID NO: 266)<br>(SEQ ID NO: 650)<br>(SEQ ID NO: 1034) |
| TTR-736 Target: | 5'-UUCCUGUGAAAGGCACUUUUCAUtc-3'<br>3'-GUAAGGACACUUUCCGUGAAAAGUAAG-5'<br>5'-CATTCCTGTGAAAGGCACTTTTCATTC-3' | (SEQ ID NO: 267)<br>(SEQ ID NO: 651)<br>(SEQ ID NO: 1035) |

TABLE 2-continued

Selected Human Anti-transthyretin DsiRNA Agents (Asymmetrics)

| | | |
|---|---|---|
| TTR-738 Target: | 5'-CCUGUGAAAGGCACUUUUCAUUCca-3'<br>3'-AAGGACACUUUCCGUGAAAAGUAAGGU-5'<br>5'-TTCCTGTGAAAGGCACTTTTCATTCCA-3' | (SEQ ID NO: 268)<br>(SEQ ID NO: 652)<br>(SEQ ID NO: 1036) |
| TTR-739 Target: | 5'-CUGUGAAAGGCACUUUUCAUUCCac-3'<br>3'-AGGACACUUUCCGUGAAAAGUAAGGUG-5'<br>5'-TCCTGTGAAAGGCACTTTTCATTCCAC-3' | (SEQ ID NO: 269)<br>(SEQ ID NO: 653)<br>(SEQ ID NO: 1037) |
| TTR-740 Target: | 5'-UGUGAAAGGCACUUUUCAUUCCAct-3'<br>3'-GGACACUUUCCGUGAAAAGUAAGGUGA-5'<br>5'-CCTGTGAAAGGCACTTTTCATTCCACT-3' | (SEQ ID NO: 270)<br>(SEQ ID NO: 654)<br>(SEQ ID NO: 1038) |
| TTR-741 Target: | 5'-GUGAAAGGCACUUUUCAUUCCACtt-3'<br>3'-GACACUUUCCGUGAAAAGUAAGGUGAA-5'<br>5'-CTGTGAAAGGCACTTTTCATTCCACTT-3' | (SEQ ID NO: 271)<br>(SEQ ID NO: 655)<br>(SEQ ID NO: 1039) |
| TTR-742 Target: | 5'-UGAAAGGCACUUUUCAUUCCACUtt-3'<br>3'-ACACUUUCCGUGAAAAGUAAGGUGAAA-5'<br>5'-TGTGAAAGGCACTTTTCATTCCACTTT-3' | (SEQ ID NO: 272)<br>(SEQ ID NO: 656)<br>(SEQ ID NO: 1040) |
| TTR-743 Target: | 5'-GAAAGGCACUUUUCAUUCCACUUta-3'<br>3'-CACUUUCCGUGAAAAGUAAGGUGAAAU-5'<br>5'-GTGAAAGGCACTTTTCATTCCACTTTA-3' | (SEQ ID NO: 273)<br>(SEQ ID NO: 657)<br>(SEQ ID NO: 1041) |
| TTR-744 Target: | 5'-AAAGGCACUUUUCAUUCCACUUUaa-3'<br>3'-ACUUUCCGUGAAAAGUAAGGUGAAAUU-5'<br>5'-TGAAAGGCACTTTTCATTCCACTTTAA-3' | (SEQ ID NO: 274)<br>(SEQ ID NO: 658)<br>(SEQ ID NO: 1042) |
| TTR-745 Target: | 5'-AAGGCACUUUUCAUUCCACUUUAac-3'<br>3'-CUUUCCGUGAAAAGUAAGGUGAAAUUG-5'<br>5'-GAAAGGCACTTTTCATTCCACTTTAAC-3' | (SEQ ID NO: 275)<br>(SEQ ID NO: 659)<br>(SEQ ID NO: 1043) |
| TTR-746 Target: | 5'-AGGCACUUUUCAUUCCACUUUAAct-3'<br>3'-UUUCCGUGAAAAGUAAGGUGAAAUUGA-5'<br>5'-AAAGGCACTTTTCATTCCACTTTAACT-3' | (SEQ ID NO: 276)<br>(SEQ ID NO: 660)<br>(SEQ ID NO: 1044) |
| TTR-747 Target: | 5'-GGCACUUUUCAUUCCACUUUAACtt-3'<br>3'-UUCCGUGAAAAGUAAGGUGAAAUUGAA-5'<br>5'-AAGGCACTTTTCATTCCACTTTAACTT-3' | (SEQ ID NO: 277)<br>(SEQ ID NO: 661)<br>(SEQ ID NO: 1045) |
| TTR-748 Target: | 5'-GCACUUUUCAUUCCACUUUAACUtg-3'<br>3'-UCCGUGAAAAGUAAGGUGAAAUUGAAC-5'<br>5'-AGGCACTTTTCATTCCACTTTAACTTG-3' | (SEQ ID NO: 278)<br>(SEQ ID NO: 662)<br>(SEQ ID NO: 1046) |
| TTR-749 Target: | 5'-CACUUUUCAUUCCACUUUAACUUga-3'<br>3'-CCGUGAAAAGUAAGGUGAAAUUGAACU-5'<br>5'-GGCACTTTTCATTCCACTTTAACTTGA-3' | (SEQ ID NO: 279)<br>(SEQ ID NO: 663)<br>(SEQ ID NO: 1047) |
| TTR-750 Target: | 5'-ACUUUUCAUUCCACUUUAACUUGat-3'<br>3'-CGUGAAAAGUAAGGUGAAAUUGAACUA-5'<br>5'-GCACTTTTCATTCCACTTTAACTTGAT-3' | (SEQ ID NO: 280)<br>(SEQ ID NO: 664)<br>(SEQ ID NO: 1048) |
| TTR-751 Target: | 5'-CUUUUCAUUCCACUUUAACUUGAtt-3'<br>3'-GUGAAAAGUAAGGUGAAAUUGAACUAA-5'<br>5'-CACTTTTCATTCCACTTTAACTTGATT-3' | (SEQ ID NO: 281)<br>(SEQ ID NO: 665)<br>(SEQ ID NO: 1049) |
| TTR-752 Target: | 5'-UUUUCAUUCCACUUUAACUUGAUtt-3'<br>3'-UGAAAAGUAAGGUGAAAUUGAACUAAA-5'<br>5'-ACTTTTCATTCCACTTTAACTTGATTT-3' | (SEQ ID NO: 282)<br>(SEQ ID NO: 666)<br>(SEQ ID NO: 1050) |
| TTR-753 Target: | 5'-UUUCAUUCCACUUUAACUUGAUUtt-3'<br>3'-GAAAAGUAAGGUGAAAUUGAACUAAAA-5'<br>5'-CTTTTCATTCCACTTTAACTTGATTTT-3' | (SEQ ID NO: 283)<br>(SEQ ID NO: 667)<br>(SEQ ID NO: 1051) |
| TTR-754 Target: | 5'-UUCAUUCCACUUUAACUUGAUUUtt-3'<br>3'-AAAAGUAAGGUGAAAUUGAACUAAAAA-5'<br>5'-TTTTCATTCCACTTTAACTTGATTTTT-3' | (SEQ ID NO: 284)<br>(SEQ ID NO: 668)<br>(SEQ ID NO: 1052) |
| TTR-755 Target: | 5'-UCAUUCCACUUUAACUUGAUUUUtt-3'<br>3'-AAAGUAAGGUGAAAUUGAACUAAAAAA-5'<br>5'-TTTCATTCCACTTTAACTTGATTTTTT-3' | (SEQ ID NO: 285)<br>(SEQ ID NO: 669)<br>(SEQ ID NO: 1053) |
| TTR-756 Target: | 5'-CAUUCCACUUUAACUUGAUUUUUta-3'<br>3'-AAGUAAGGUGAAAUUGAACUAAAAAAU-5'<br>5'-TTCATTCCACTTTAACTTGATTTTTTA-3' | (SEQ ID NO: 286)<br>(SEQ ID NO: 670)<br>(SEQ ID NO: 1054) |

TABLE 2-continued

Selected Human Anti-transthyretin DsiRNA Agents (Asymmetrics)

| | | |
|---|---|---|
| TTR-757 | 5'-AUUCCACUUUAACUUGAUUUUUUaa-3'<br>3'-AGUAAGGUGAAAUUGAACUAAAAAAUU-5'<br>Target: 5'-TCATTCCACTTTAACTTGATTTTTTAA-3' | (SEQ ID NO: 287)<br>(SEQ ID NO: 671)<br>(SEQ ID NO: 1055) |
| TTR-758 | 5'-UUCCACUUUAACUUGAUUUUUUAaa-3'<br>3'-GUAAGGUGAAAUUGAACUAAAAAAUUU-5'<br>Target: 5'-CATTCCACTTTAACTTGATTTTTTAAA-3' | (SEQ ID NO: 288)<br>(SEQ ID NO: 672)<br>(SEQ ID NO: 1056) |
| TTR-759 | 5'-UCCACUUUAACUUGAUUUUUUAAat-3'<br>3'-UAAGGUGAAAUUGAACUAAAAAAUUUA-5'<br>Target: 5'-ATTCCACTTTAACTTGATTTTTTAAAT-3' | (SEQ ID NO: 289)<br>(SEQ ID NO: 673)<br>(SEQ ID NO: 1057) |
| TTR-760 | 5'-CCACUUUAACUUGAUUUUUUAAAtt-3'<br>3'-AAGGUGAAAUUGAACUAAAAAAUUUAA-5'<br>Target: 5'-TTCCACTTTAACTTGATTTTTTAAATT-3' | (SEQ ID NO: 290)<br>(SEQ ID NO: 674)<br>(SEQ ID NO: 1058) |
| TTR-761 | 5'-CACUUUAACUUGAUUUUUUAAAUtc-3'<br>3'-AGGUGAAAUUGAACUAAAAAAUUUAAG-5'<br>Target: 5'-TCCACTTTAACTTGATTTTTTAAATTC-3' | (SEQ ID NO: 291)<br>(SEQ ID NO: 675)<br>(SEQ ID NO: 1059) |
| TTR-762 | 5'-ACUUUAACUUGAUUUUUUAAAUUcc-3'<br>3'-GGUGAAAUUGAACUAAAAAAUUUAAGG-5'<br>Target: 5'-CCACTTTAACTTGATTTTTTAAATTCC-3' | (SEQ ID NO: 292)<br>(SEQ ID NO: 676)<br>(SEQ ID NO: 1060) |
| TTR-763 | 5'-CUUUAACUUGAUUUUUUAAAUUCcc-3'<br>3'-GUGAAAUUGAACUAAAAAAUUUAAGGG-5'<br>Target: 5'-CACTTTAACTTGATTTTTTAAATTCCC-3' | (SEQ ID NO: 293)<br>(SEQ ID NO: 677)<br>(SEQ ID NO: 1061) |
| TTR-764 | 5'-UUUAACUUGAUUUUUUAAAUUCCct-3'<br>3'-UGAAAUUGAACUAAAAAAUUUAAGGGA-5'<br>Target: 5'-ACTTTAACTTGATTTTTTAAATTCCCT-3' | (SEQ ID NO: 294)<br>(SEQ ID NO: 678)<br>(SEQ ID NO: 1062) |
| TTR-765 | 5'-UUAACUUGAUUUUUUAAAUUCCCtt-3'<br>3'-GAAAUUGAACUAAAAAAUUUAAGGGAA-5'<br>Target: 5'-CTTTAACTTGATTTTTTAAATTCCCTT-3' | (SEQ ID NO: 295)<br>(SEQ ID NO: 679)<br>(SEQ ID NO: 1063) |
| TTR-766 | 5'-UAACUUGAUUUUUUAAAUUCCCUta-3'<br>3'-AAAUUGAACUAAAAAAUUUAAGGGAAU-5'<br>Target: 5'-TTTAACTTGATTTTTTAAATTCCCTTA-3' | (SEQ ID NO: 296)<br>(SEQ ID NO: 680)<br>(SEQ ID NO: 1064) |
| TTR-767 | 5'-AACUUGAUUUUUUAAAUUCCCUUat-3'<br>3'-AAUUGAACUAAAAAAUUUAAGGGAAUA-5'<br>Target: 5'-TTAACTTGATTTTTTAAATTCCCTTAT-3' | (SEQ ID NO: 297)<br>(SEQ ID NO: 681)<br>(SEQ ID NO: 1065) |
| TTR-768 | 5'-ACUUGAUUUUUUAAAUUCCCUUAtt-3'<br>3'-AUUGAACUAAAAAAUUUAAGGGAAUAA-5'<br>Target: 5'-TAACTTGATTTTTTAAATTCCCTTATT-3' | (SEQ ID NO: 298)<br>(SEQ ID NO: 682)<br>(SEQ ID NO: 1066) |
| TTR-769 | 5'-CUUGAUUUUUUAAAUUCCCUUAUtg-3'<br>3'-UUGAACUAAAAAAUUUAAGGGAAUAAC-5'<br>Target: 5'-AACTTGATTTTTTAAATTCCCTTATTG-3' | (SEQ ID NO: 299)<br>(SEQ ID NO: 683)<br>(SEQ ID NO: 1067) |
| TTR-770 | 5'-UUGAUUUUUUAAAUUCCCUUAUUgt-3'<br>3'-UGAACUAAAAAAUUUAAGGGAAUAACA-5'<br>Target: 5'-ACTTGATTTTTTAAATTCCCTTATTGT-3' | (SEQ ID NO: 300)<br>(SEQ ID NO: 684)<br>(SEQ ID NO: 1068) |
| TTR-771 | 5'-UGAUUUUUUAAAUUCCCUUAUUGtc-3'<br>3'-GAACUAAAAAAUUUAAGGGAAUAACAG-5'<br>Target: 5'-CTTGATTTTTTAAATTCCCTTATTGTC-3' | (SEQ ID NO: 301)<br>(SEQ ID NO: 685)<br>(SEQ ID NO: 1069) |
| TTR-772 | 5'-GAUUUUUUAAAUUCCCUUAUUGUcc-3'<br>3'-AACUAAAAAAUUUAAGGGAAUAACAGG-5'<br>Target: 5'-TTGATTTTTTAAATTCCCTTATTGTCC-3' | (SEQ ID NO: 302)<br>(SEQ ID NO: 686)<br>(SEQ ID NO: 1070) |
| TTR-773 | 5'-AUUUUUUAAAUUCCCUUAUUGUCcc-3'<br>3'-ACUAAAAAAUUUAAGGGAAUAACAGGG-5'<br>Target: 5'-TGATTTTTTAAATTCCCTTATTGTCCC-3' | (SEQ ID NO: 303)<br>(SEQ ID NO: 687)<br>(SEQ ID NO: 1071) |
| TTR-775 | 5'-UUUUUAAAUUCCCUUAUUGUCCCtt-3'<br>3'-UAAAAAAUUUAAGGGAAUAACAGGGAA-5'<br>Target: 5'-ATTTTTTAAATTCCCTTATTGTCCCTT-3' | (SEQ ID NO: 304)<br>(SEQ ID NO: 688)<br>(SEQ ID NO: 1072) |
| TTR-780 | 5'-AAAUUCCCUUAUUGUCCCUUCCAaa-3'<br>3'-AAUUUAAGGGAAUAACAGGGAAGGUUU-5'<br>Target: 5'-TTAAATTCCCTTATTGTCCCTTCCAAA-3' | (SEQ ID NO: 305)<br>(SEQ ID NO: 689)<br>(SEQ ID NO: 1073) |

TABLE 2-continued

Selected Human Anti-transthyretin DsiRNA Agents (Asymmetrics)

|   |   |   |
|---|---|---|
| TTR-781 Target: | 5'-AAUUCCCUUAUUGUCCCUUCCAAaa-3'<br>3'-AUUUAAGGGAAUAACAGGGAAGGUUUU-5'<br>5'-TAAATTCCCTTATTGTCCCTTCCAAAA-3' | (SEQ ID NO: 306)<br>(SEQ ID NO: 690)<br>(SEQ ID NO: 1074) |
| TTR-784 Target: | 5'-UCCCUUAUUGUCCCUUCCAAAAAaa-3'<br>3'-UAAGGGAAUAACAGGGAAGGUUUUUUU-5'<br>5'-ATTCCCTTATTGTCCCTTCCAAAAAAA-3' | (SEQ ID NO: 307)<br>(SEQ ID NO: 691)<br>(SEQ ID NO: 1075) |
| TTR-805 Target: | 5'-AAAAAGAGAAUCAAAAUUUUACAaa-3'<br>3'-UUUUUUUCUCUUAGUUUUAAAAUGUUU-5'<br>5'-AAAAAAAGAGAATCAAAATTTTACAAA-3' | (SEQ ID NO: 308)<br>(SEQ ID NO: 692)<br>(SEQ ID NO: 1076) |
| TTR-806 Target: | 5'-AAAAGAGAAUCAAAAUUUUACAAag-3'<br>3'-UUUUUUCUCUUAGUUUUAAAAUGUUUC-5'<br>5'-AAAAAAGAGAATCAAAATTTTACAAAG-3' | (SEQ ID NO: 309)<br>(SEQ ID NO: 693)<br>(SEQ ID NO: 1077) |
| TTR-807 Target: | 5'-AAAGAGAAUCAAAAUUUUACAAAga-3'<br>3'-UUUUUCUCUUAGUUUUAAAAUGUUUCU-5'<br>5'-AAAAAGAGAATCAAAATTTTACAAAGA-3' | (SEQ ID NO: 310)<br>(SEQ ID NO: 694)<br>(SEQ ID NO: 1078) |
| TTR-808 Target: | 5'-AAGAGAAUCAAAAUUUUACAAAGaa-3'<br>3'-UUUUCUCUUAGUUUUAAAAUGUUUCUU-5'<br>5'-AAAAGAGAATCAAAATTTTACAAAGAA-3' | (SEQ ID NO: 311)<br>(SEQ ID NO: 695)<br>(SEQ ID NO: 1079) |
| TTR-809 Target: | 5'-AGAGAAUCAAAAUUUUACAAAGAat-3'<br>3'-UUUCUCUUAGUUUUAAAAUGUUUCUUA-5'<br>5'-AAAGAGAATCAAAATTTTACAAAGAAT-3' | (SEQ ID NO: 312)<br>(SEQ ID NO: 696)<br>(SEQ ID NO: 1080) |
| TTR-810 Target: | 5'-GAGAAUCAAAAUUUUACAAAGAAtc-3'<br>3'-UUCUCUUAGUUUUAAAAUGUUUCUUAG-5'<br>5'-AAGAGAATCAAAATTTTACAAAGAATC-3' | (SEQ ID NO: 313)<br>(SEQ ID NO: 697)<br>(SEQ ID NO: 1081) |
| TTR-811 Target: | 5'-AGAAUCAAAAUUUUACAAAGAAUca-3'<br>3'-UCUCUUAGUUUUAAAAUGUUUCUUAGU-5'<br>5'-AGAGAATCAAAATTTTACAAAGAATCA-3' | (SEQ ID NO: 314)<br>(SEQ ID NO: 698)<br>(SEQ ID NO: 1082) |
| TTR-812 Target: | 5'-GAAUCAAAAUUUUACAAAGAAUCaa-3'<br>3'-CUCUUAGUUUUAAAAUGUUUCUUAGUU-5'<br>5'-GAGAATCAAAATTTTACAAAGAATCAA-3' | (SEQ ID NO: 315)<br>(SEQ ID NO: 699)<br>(SEQ ID NO: 1083) |
| TTR-813 Target: | 5'-AAUCAAAAUUUUACAAAGAAUCAaa-3'<br>3'-UCUUAGUUUUAAAAUGUUUCUUAGUUU-5'<br>5'-AGAATCAAAATTTTACAAAGAATCAAA-3' | (SEQ ID NO: 316)<br>(SEQ ID NO: 700)<br>(SEQ ID NO: 1084) |
| TTR-814 Target: | 5'-AUCAAAAUUUUACAAAGAAUCAAag-3'<br>3'-CUUAGUUUUAAAAUGUUUCUUAGUUUC-5'<br>5'-GAATCAAAATTTTACAAAGAATCAAAG-3' | (SEQ ID NO: 317)<br>(SEQ ID NO: 701)<br>(SEQ ID NO: 1085) |
| TTR-815 Target: | 5'-UCAAAAUUUUACAAAGAAUCAAAgg-3'<br>3'-UUAGUUUUAAAAUGUUUCUUAGUUUCC-5'<br>5'-AATCAAAATTTTACAAAGAATCAAAGG-3' | (SEQ ID NO: 318)<br>(SEQ ID NO: 702)<br>(SEQ ID NO: 1086) |
| TTR-816 Target: | 5'-CAAAAUUUUACAAAGAAUCAAAGga-3'<br>3'-UAGUUUUAAAAUGUUUCUUAGUUUCCU-5'<br>5'-ATCAAAATTTTACAAAGAATCAAAGGA-3' | (SEQ ID NO: 319)<br>(SEQ ID NO: 703)<br>(SEQ ID NO: 1087) |
| TTR-817 Target: | 5'-AAAAUUUUACAAAGAAUCAAAGGaa-3'<br>3'-AGUUUUAAAAUGUUUCUUAGUUUCCUU-5'<br>5'-TCAAAATTTTACAAAGAATCAAAGGAA-3' | (SEQ ID NO: 320)<br>(SEQ ID NO: 704)<br>(SEQ ID NO: 1088) |
| TTR-818 Target: | 5'-AAAUUUUACAAAGAAUCAAAGGAat-3'<br>3'-GUUUUAAAAUGUUUCUUAGUUUCCUUA-5'<br>5'-CAAAATTTTACAAAGAATCAAAGGAAT-3' | (SEQ ID NO: 321)<br>(SEQ ID NO: 705)<br>(SEQ ID NO: 1089) |
| TTR-819 Target: | 5'-AAUUUUACAAAGAAUCAAAGGAAtt-3'<br>3'-UUUUAAAAUGUUUCUUAGUUUCCUUAA-5'<br>5'-AAAATTTTACAAAGAATCAAAGGAATT-3' | (SEQ ID NO: 322)<br>(SEQ ID NO: 706)<br>(SEQ ID NO: 1090) |
| TTR-821 Target: | 5'-UUUUACAAAGAAUCAAAGGAAUUct-3'<br>3'-UUAAAAUGUUUCUUAGUUUCCUUAAGA-5'<br>5'-AATTTTACAAAGAATCAAAGGAATTCT-3' | (SEQ ID NO: 323)<br>(SEQ ID NO: 707)<br>(SEQ ID NO: 1091) |
| TTR-822 Target: | 5'-UUUACAAAGAAUCAAAGGAAUUCta-3'<br>3'-UAAAAUGUUUCUUAGUUUCCUUAAGAU-5'<br>5'-ATTTTACAAAGAATCAAAGGAATTCTA-3' | (SEQ ID NO: 324)<br>(SEQ ID NO: 708)<br>(SEQ ID NO: 1092) |

TABLE 2-continued

Selected Human Anti-transthyretin DsiRNA Agents (Asymmetrics)

| | | |
|---|---|---|
| TTR-823 Target: | 5'-UUACAAAGAAUCAAAGGAAUUCUag-3'<br>3'-AAAAUGUUUCUUAGUUUCCUUAAGAUC-5'<br>5'-TTTTACAAAGAATCAAAGGAATTCTAG-3' | (SEQ ID NO: 325)<br>(SEQ ID NO: 709)<br>(SEQ ID NO: 1093) |
| TTR-824 Target: | 5'-UACAAAGAAUCAAAGGAAUUCUAga-3'<br>3'-AAAUGUUUCUUAGUUUCCUUAAGAUCU-5'<br>5'-TTTACAAAGAATCAAAGGAATTCTAGA-3' | (SEQ ID NO: 326)<br>(SEQ ID NO: 710)<br>(SEQ ID NO: 1094) |
| TTR-825 Target: | 5'-ACAAAGAAUCAAAGGAAUUCUAGaa-3'<br>3'-AAUGUUUCUUAGUUUCCUUAAGAUCUU-5'<br>5'-TTACAAAGAATCAAAGGAATTCTAGAA-3' | (SEQ ID NO: 327)<br>(SEQ ID NO: 711)<br>(SEQ ID NO: 1095) |
| TTR-826 Target: | 5'-CAAAGAAUCAAAGGAAUUCUAGAaa-3'<br>3'-AUGUUUCUUAGUUUCCUUAAGAUCUUU-5'<br>5'-TACAAAGAATCAAAGGAATTCTAGAAA-3' | (SEQ ID NO: 328)<br>(SEQ ID NO: 712)<br>(SEQ ID NO: 1096) |
| TTR-827 Target: | 5'-AAAGAAUCAAAGGAAUUCUAGAAag-3'<br>3'-UGUUUCUUAGUUUCCUUAAGAUCUUUC-5'<br>5'-ACAAAGAATCAAAGGAATTCTAGAAAG-3' | (SEQ ID NO: 329)<br>(SEQ ID NO: 713)<br>(SEQ ID NO: 1097) |
| TTR-828 Target: | 5'-AAGAAUCAAAGGAAUUCUAGAAAgt-3'<br>3'-GUUUCUUAGUUUCCUUAAGAUCUUUCA-5'<br>5'-CAAAGAATCAAAGGAATTCTAGAAAGT-3' | (SEQ ID NO: 330)<br>(SEQ ID NO: 714)<br>(SEQ ID NO: 1098) |
| TTR-829 Target: | 5'-AGAAUCAAAGGAAUUCUAGAAAGta-3'<br>3'-UUUCUUAGUUUCCUUAAGAUCUUUCAU-5'<br>5'-AAAGAATCAAAGGAATTCTAGAAAGTA-3' | (SEQ ID NO: 331)<br>(SEQ ID NO: 715)<br>(SEQ ID NO: 1099) |
| TTR-830 Target: | 5'-GAAUCAAAGGAAUUCUAGAAAGUat-3'<br>3'-UUCUUAGUUUCCUUAAGAUCUUUCAUA-5'<br>5'-AAGAATCAAAGGAATTCTAGAAAGTAT-3' | (SEQ ID NO: 332)<br>(SEQ ID NO: 716)<br>(SEQ ID NO: 1100) |
| TTR-831 Target: | 5'-AAUCAAAGGAAUUCUAGAAAGUAtc-3'<br>3'-UCUUAGUUUCCUUAAGAUCUUUCAUAG-5'<br>5'-AGAATCAAAGGAATTCTAGAAAGTATC-3' | (SEQ ID NO: 333)<br>(SEQ ID NO: 717)<br>(SEQ ID NO: 1101) |
| TTR-832 Target: | 5'-AUCAAAGGAAUUCUAGAAAGUAUct-3'<br>3'-CUUAGUUUCCUUAAGAUCUUUCAUAGA-5'<br>5'-GAATCAAAGGAATTCTAGAAAGTATCT-3' | (SEQ ID NO: 334)<br>(SEQ ID NO: 718)<br>(SEQ ID NO: 1102) |
| TTR-833 Target: | 5'-UCAAAGGAAUUCUAGAAAGUAUCtg-3'<br>3'-UUAGUUUCCUUAAGAUCUUUCAUAGAC-5'<br>5'-AATCAAAGGAATTCTAGAAAGTATCTG-3' | (SEQ ID NO: 335)<br>(SEQ ID NO: 719)<br>(SEQ ID NO: 1103) |
| TTR-834 Target: | 5'-CAAAGGAAUUCUAGAAAGUAUCUgg-3'<br>3'-UAGUUUCCUUAAGAUCUUUCAUAGACC-5'<br>5'-ATCAAAGGAATTCTAGAAAGTATCTGG-3' | (SEQ ID NO: 336)<br>(SEQ ID NO: 720)<br>(SEQ ID NO: 1104) |
| TTR-835 Target: | 5'-AAAGGAAUUCUAGAAAGUAUCUGgg-3'<br>3'-AGUUUCCUUAAGAUCUUUCAUAGACCC-5'<br>5'-TCAAAGGAATTCTAGAAAGTATCTGGG-3' | (SEQ ID NO: 337)<br>(SEQ ID NO: 721)<br>(SEQ ID NO: 1105) |
| TTR-869 Target: | 5'-AGGAGAGAUCCAAAUUUCCAUUGtc-3'<br>3'-GAUCCUCUCUAGGUUUAAAGGUAACAG-5'<br>5'-CTAGGAGAGATCCAAATTTCCATTGTC-3' | (SEQ ID NO: 338)<br>(SEQ ID NO: 722)<br>(SEQ ID NO: 1106) |
| TTR-870 Target: | 5'-GGAGAGAUCCAAAUUUCCAUUGUct-3'<br>3'-AUCCUCUCUAGGUUUAAAGGUAACAGA-5'<br>5'-TAGGAGAGATCCAAATTTCCATTGTCT-3' | (SEQ ID NO: 339)<br>(SEQ ID NO: 723)<br>(SEQ ID NO: 1107) |
| TTR-873 Target: | 5'-GAGAUCCAAAUUUCCAUUGUCUUgc-3'<br>3'-CUCUCUAGGUUUAAAGGUAACAGAACG-5'<br>5'-GAGAGATCCAAATTTCCATTGTCTTGC-3' | (SEQ ID NO: 340)<br>(SEQ ID NO: 724)<br>(SEQ ID NO: 1108) |
| TTR-874 Target: | 5'-AGAUCCAAAUUUCCAUUGUCUUGca-3'<br>3'-UCUCUAGGUUUAAAGGUAACAGAACGU-5'<br>5'-AGAGATCCAAATTTCCATTGTCTTGCA-3' | (SEQ ID NO: 341)<br>(SEQ ID NO: 725)<br>(SEQ ID NO: 1109) |
| TTR-875 Target: | 5'-GAUCCAAAUUUCCAUUGUCUUGCaa-3'<br>3'-CUCUAGGUUUAAAGGUAACAGAACGUU-5'<br>5'-GAGATCCAAATTTCCATTGTCTTGCAA-3' | (SEQ ID NO: 342)<br>(SEQ ID NO: 726)<br>(SEQ ID NO: 1110) |
| TTR-876 Target: | 5'-AUCCAAAUUUCCAUUGUCUUGCAag-3'<br>3'-UCUAGGUUUAAAGGUAACAGAACGUUC-5'<br>5'-AGATCCAAATTTCCATTGTCTTGCAAG-3' | (SEQ ID NO: 343)<br>(SEQ ID NO: 727)<br>(SEQ ID NO: 1111) |

TABLE 2-continued

Selected Human Anti-transthyretin DsiRNA Agents (Asymmetrics)

| | | |
|---|---|---|
| TTR-877 | 5'-UCCAAAUUUCCAUUGUCUUGCAAgc-3'<br>3'-CUAGGUUUAAAGGUAACAGAACGUUCG-5'<br>Target: 5'-GATCCAAATTTCCATTGTCTTGCAAGC-3' | (SEQ ID NO: 344)<br>(SEQ ID NO: 728)<br>(SEQ ID NO: 1112) |
| TTR-878 | 5'-CCAAAUUUCCAUUGUCUUGCAAGca-3'<br>3'-UAGGUUUAAAGGUAACAGAACGUUCGU-5'<br>Target: 5'-ATCCAAATTTCCATTGTCTTGCAAGCA-3' | (SEQ ID NO: 345)<br>(SEQ ID NO: 729)<br>(SEQ ID NO: 1113) |
| TTR-879 | 5'-CAAAUUUCCAUUGUCUUGCAAGCaa-3'<br>3'-AGGUUUAAAGGUAACAGAACGUUCGUU-5'<br>Target: 5'-TCCAAATTTCCATTGTCTTGCAAGCAA-3' | (SEQ ID NO: 346)<br>(SEQ ID NO: 730)<br>(SEQ ID NO: 1114) |
| TTR-880 | 5'-AAAUUUCCAUUGUCUUGCAAGCAaa-3'<br>3'-GGUUUAAAGGUAACAGAACGUUCGUUU-5'<br>Target: 5'-CCAAATTTCCATTGTCTTGCAAGCAAA-3' | (SEQ ID NO: 347)<br>(SEQ ID NO: 731)<br>(SEQ ID NO: 1115) |
| TTR-881 | 5'-AAUUUCCAUUGUCUUGCAAGCAAg-3'<br>3'-GUUUAAAGGUAACAGAACGUUCGUUUC-5'<br>Target: 5'-CAAATTTCCATTGTCTTGCAAGCAAAG-3' | (SEQ ID NO: 348)<br>(SEQ ID NO: 732)<br>(SEQ ID NO: 1116) |
| TTR-882 | 5'-AUUUCCAUUGUCUUGCAAGCAAAgc-3'<br>3'-UUUAAAGGUAACAGAACGUUCGUUUCG-5'<br>Target: 5'-AAATTTCCATTGTCTTGCAAGCAAAGC-3' | (SEQ ID NO: 349)<br>(SEQ ID NO: 733)<br>(SEQ ID NO: 1117) |
| TTR-883 | 5'-UUUCCAUUGUCUUGCAAGCAAAGca-3'<br>3'-UUAAAGGUAACAGAACGUUCGUUUCGU-5'<br>Target: 5'-AATTTCCATTGTCTTGCAAGCAAAGCA-3' | (SEQ ID NO: 350)<br>(SEQ ID NO: 734)<br>(SEQ ID NO: 1118) |
| TTR-884 | 5'-UUCCAUUGUCUUGCAAGCAAAGCac-3'<br>3'-UAAAGGUAACAGAACGUUCGUUUCGUG-5'<br>Target: 5'-ATTTCCATTGTCTTGCAAGCAAAGCAC-3' | (SEQ ID NO: 351)<br>(SEQ ID NO: 735)<br>(SEQ ID NO: 1119) |
| TTR-885 | 5'-UCCAUUGUCUUGCAAGCAAAGCAcg-3'<br>3'-AAAGGUAACAGAACGUUCGUUUCGUGC-5'<br>Target: 5'-TTTCCATTGTCTTGCAAGCAAAGCACG-3' | (SEQ ID NO: 352)<br>(SEQ ID NO: 736)<br>(SEQ ID NO: 1120) |
| TTR-886 | 5'-CCAUUGUCUUGCAAGCAAAGCACgt-3'<br>3'-AAGGUAACAGAACGUUCGUUUCGUGCA-5'<br>Target: 5'-TTCCATTGTCTTGCAAGCAAAGCACGT-3' | (SEQ ID NO: 353)<br>(SEQ ID NO: 737)<br>(SEQ ID NO: 1121) |
| TTR-887 | 5'-CAUUGUCUUGCAAGCAAAGCACGta-3'<br>3'-AGGUAACAGAACGUUCGUUUCGUGCAU-5'<br>Target: 5'-TCCATTGTCTTGCAAGCAAAGCACGTA-3' | (SEQ ID NO: 354)<br>(SEQ ID NO: 738)<br>(SEQ ID NO: 1122) |
| TTR-888 | 5'-AUUGUCUUGCAAGCAAAGCACGUat-3'<br>3'-GGUAACAGAACGUUCGUUUCGUGCAUA-5'<br>Target: 5'-CCATTGTCTTGCAAGCAAAGCACGTAT-3' | (SEQ ID NO: 355)<br>(SEQ ID NO: 739)<br>(SEQ ID NO: 1123) |
| TTR-889 | 5'-UUGUCUUGCAAGCAAAGCACGUAtt-3'<br>3'-GUAACAGAACGUUCGUUUCGUGCAUAA-5'<br>Target: 5'-CATTGTCTTGCAAGCAAAGCACGTATT-3' | (SEQ ID NO: 356)<br>(SEQ ID NO: 740)<br>(SEQ ID NO: 1124) |
| TTR-890 | 5'-UGUCUUGCAAGCAAAGCACGUAUta-3'<br>3'-UAACAGAACGUUCGUUUCGUGCAUAAU-5'<br>Target: 5'-ATTGTCTTGCAAGCAAAGCACGTATTA-3' | (SEQ ID NO: 357)<br>(SEQ ID NO: 741)<br>(SEQ ID NO: 1125) |
| TTR-891 | 5'-GUCUUGCAAGCAAAGCACGUAUUaa-3'<br>3'-AACAGAACGUUCGUUUCGUGCAUAAUU-5'<br>Target: 5'-TTGTCTTGCAAGCAAAGCACGTATTAA-3' | (SEQ ID NO: 358)<br>(SEQ ID NO: 742)<br>(SEQ ID NO: 1126) |
| TTR-892 | 5'-UCUUGCAAGCAAAGCACGUAUUAaa-3'<br>3'-ACAGAACGUUCGUUUCGUGCAUAAUUU-5'<br>Target: 5'-TGTCTTGCAAGCAAAGCACGTATTAAA-3' | (SEQ ID NO: 359)<br>(SEQ ID NO: 743)<br>(SEQ ID NO: 1127) |
| TTR-893 | 5'-CUUGCAAGCAAAGCACGUAUUAAat-3'<br>3'-CAGAACGUUCGUUUCGUGCAUAAUUUA-5'<br>Target: 5'-GTCTTGCAAGCAAAGCACGTATTAAAT-3' | (SEQ ID NO: 360)<br>(SEQ ID NO: 744)<br>(SEQ ID NO: 1128) |
| TTR-894 | 5'-UUGCAAGCAAAGCACGUAUUAAAta-3'<br>3'-AGAACGUUCGUUUCGUGCAUAAUUUAU-5'<br>Target: 5'-TCTTGCAAGCAAAGCACGTATTAAATA-3' | (SEQ ID NO: 361)<br>(SEQ ID NO: 745)<br>(SEQ ID NO: 1129) |
| TTR-895 | 5'-UGCAAGCAAAGCACGUAUUAAAUat-3'<br>3'-GAACGUUCGUUUCGUGCAUAAUUUAUA-5'<br>Target: 5'-CTTGCAAGCAAAGCACGTATTAAATAT-3' | (SEQ ID NO: 362)<br>(SEQ ID NO: 746)<br>(SEQ ID NO: 1130) |

TABLE 2-continued

Selected Human Anti-transthyretin DsiRNA Agents (Asymmetrics)

| | | |
|---|---|---|
| | 5'-GCAAGCAAAGCACGUAUUAAAUAtg-3' | (SEQ ID NO: 363) |
| | 3'-AACGUUCGUUUCGUGCAUAAUUUAUAC-5' | (SEQ ID NO: 747) |
| TTR-896 Target: | 5'-TTGCAAGCAAAGCACGTATTAAATATG-3' | (SEQ ID NO: 1131) |
| | 5'-CAAGCAAAGCACGUAUUAAAUAUGa-3' | (SEQ ID NO: 364) |
| | 3'-ACGUUCGUUUCGUGCAUAAUUUAUACU-5' | (SEQ ID NO: 748) |
| TTR-897 Target: | 5'-TGCAAGCAAAGCACGTATTAAATATGA-3' | (SEQ ID NO: 1132) |
| | 5'-AAGCAAAGCACGUAUUAAAUAUGat-3' | (SEQ ID NO: 365) |
| | 3'-CGUUCGUUUCGUGCAUAAUUUAUACUA-5' | (SEQ ID NO: 749) |
| TTR-898 Target: | 5'-GCAAGCAAAGCACGTATTAAATATGAT-3' | (SEQ ID NO: 1133) |
| | 5'-AGCAAAGCACGUAUUAAAUAUGAtc-3' | (SEQ ID NO: 366) |
| | 3'-GUUCGUUUCGUGCAUAAUUUAUACUAG-5' | (SEQ ID NO: 750) |
| TTR-899 Target: | 5'-CAAGCAAAGCACGTATTAAATATGATC-3' | (SEQ ID NO: 1134) |
| | 5'-GCAAAGCACGUAUUAAAUAUGAUct-3' | (SEQ ID NO: 367) |
| | 3'-UUCGUUUCGUGCAUAAUUUAUACUAGA-5' | (SEQ ID NO: 751) |
| TTR-900 Target: | 5'-AAGCAAAGCACGTATTAAATATGATCT-3' | (SEQ ID NO: 1135) |
| | 5'-CAAAGCACGUAUUAAAUAUGAUCtg-3' | (SEQ ID NO: 368) |
| | 3'-UCGUUUCGUGCAUAAUUUAUACUAGAC-5' | (SEQ ID NO: 752) |
| TTR-901 Target: | 5'-AGCAAAGCACGTATTAAATATGATCTG-3' | (SEQ ID NO: 1136) |
| | 5'-AAAGCACGUAUUAAAUAUGAUCUgc-3' | (SEQ ID NO: 369) |
| | 3'-CGUUUCGUGCAUAAUUUAUACUAGACG-5' | (SEQ ID NO: 753) |
| TTR-902 Target: | 5'-GCAAAGCACGTATTAAATATGATCTGC-3' | (SEQ ID NO: 1137) |
| | 5'-AAGCACGUAUUAAAUAUGAUCUGca-3' | (SEQ ID NO: 370) |
| | 3'-GUUUCGUGCAUAAUUUAUACUAGACGU-5' | (SEQ ID NO: 754) |
| TTR-903 Target: | 5'-CAAAGCACGTATTAAATATGATCTGCA-3' | (SEQ ID NO: 1138) |
| | 5'-AGCACGUAUUAAAUAUGAUCUGCag-3' | (SEQ ID NO: 371) |
| | 3'-UUUCGUGCAUAAUUUAUACUAGACGUC-5' | (SEQ ID NO: 755) |
| TTR-904 Target: | 5'-AAAGCACGTATTAAATATGATCTGCAG-3' | (SEQ ID NO: 1139) |
| | 5'-GCACGUAUUAAAUAUGAUCUGCAgc-3' | (SEQ ID NO: 372) |
| | 3'-UUCGUGCAUAAUUUAUACUAGACGUCG-5' | (SEQ ID NO: 756) |
| TTR-905 Target: | 5'-AAGCACGTATTAAATATGATCTGCAGC-3' | (SEQ ID NO: 1140) |
| | 5'-CACGUAUUAAAUAUGAUCUGCAGcc-3' | (SEQ ID NO: 373) |
| | 3'-UCGUGCAUAAUUUAUACUAGACGUCGG-5' | (SEQ ID NO: 757) |
| TTR-906 Target: | 5'-AGCACGTATTAAATATGATCTGCAGCC-3' | (SEQ ID NO: 1141) |
| | 5'-CGUAUUAAAUAUGAUCUGCAGCCat-3' | (SEQ ID NO: 374) |
| | 3'-GUGCAUAAUUUAUACUAGACGUCGGUA-5' | (SEQ ID NO: 758) |
| TTR-908 Target: | 5'-CACGTATTAAATATGATCTGCAGCCAT-3' | (SEQ ID NO: 1142) |
| | 5'-GUAUUAAAUAUGAUCUGCAGCCAtt-3' | (SEQ ID NO: 375) |
| | 3'-UGCAUAAUUUAUACUAGACGUCGGUAA-5' | (SEQ ID NO: 759) |
| TTR-909 Target: | 5'-ACGTATTAAATATGATCTGCAGCCATT-3' | (SEQ ID NO: 1143) |
| | 5'-AUUAAAUAUGAUCUGCAGCCAUUaa-3' | (SEQ ID NO: 376) |
| | 3'-CAUAAUUUAUACUAGACGUCGGUAAUU-5' | (SEQ ID NO: 760) |
| TTR-911 Target: | 5'-GTATTAAATATGATCTGCAGCCATTAA-3' | (SEQ ID NO: 1144) |
| | 5'-UUAAAUAUGAUCUGCAGCCAUUAaa-3' | (SEQ ID NO: 377) |
| | 3'-AUAAUUUAUACUAGACGUCGGUAAUUU-5' | (SEQ ID NO: 761) |
| TTR-912 Target: | 5'-TATTAAATATGATCTGCAGCCATTAAA-3' | (SEQ ID NO: 1145) |
| | 5'-UAAAUAUGAUCUGCAGCCAUUAAaa-3' | (SEQ ID NO: 378) |
| | 3'-UAAUUUAUACUAGACGUCGGUAAUUUU-5' | (SEQ ID NO: 762) |
| TTR-913 Target: | 5'-ATTAAATATGATCTGCAGCCATTAAAA-3' | (SEQ ID NO: 1146) |
| | 5'-AAAUAUGAUCUGCAGCCAUUAAAaa-3' | (SEQ ID NO: 379) |
| | 3'-AAUUUAUACUAGACGUCGGUAAUUUUU-5' | (SEQ ID NO: 763) |
| TTR-914 Target: | 5'-TTAAATATGATCTGCAGCCATTAAAAA-3' | (SEQ ID NO: 1147) |
| | 5'-AAUAUGAUCUGCAGCCAUUAAAAag-3' | (SEQ ID NO: 380) |
| | 3'-AUUUAUACUAGACGUCGGUAAUUUUUC-5' | (SEQ ID NO: 764) |
| TTR-915 Target: | 5'-TAAATATGATCTGCAGCCATTAAAAAG-3' | (SEQ ID NO: 1148) |
| | 5'-AUAUGAUCUGCAGCCAUUAAAAAga-3' | (SEQ ID NO: 381) |
| | 3'-UUUAUACUAGACGUCGGUAAUUUUUCU-5' | (SEQ ID NO: 765) |
| TTR-916 Target: | 5'-AAATATGATCTGCAGCCATTAAAAAGA-3' | (SEQ ID NO: 1149) |

TABLE 2-continued

Selected Human Anti-transthyretin DsiRNA Agents (Asymmetrics)

|  |  |  |
|---|---|---|
| TTR-917 | 5'-UAUGAUCUGCAGCCAUUAAAAAGac-3'<br>3'-UUAUACUAGACGUCGGUAAUUUUUCUG-5'<br>Target: 5'-AATATGATCTGCAGCCATTAAAAAGAC-3' | (SEQ ID NO: 382)<br>(SEQ ID NO: 766)<br>(SEQ ID NO: 1150) |
| TTR-918 | 5'-AUGAUCUGCAGCCAUUAAAAAGAca-3'<br>3'-UAUACUAGACGUCGGUAAUUUUUCUGU-5'<br>Target: 5'-ATATGATCTGCAGCCATTAAAAAGACA-3' | (SEQ ID NO: 383)<br>(SEQ ID NO: 767)<br>(SEQ ID NO: 1151) |
| TTR-919 | 5'-UGAUCUGCAGCCAUUAAAAAGACac-3'<br>3'-AUACUAGACGUCGGUAAUUUUUCUGUG-5'<br>Target: 5'-TATGATCTGCAGCCATTAAAAAGACAC-3' | (SEQ ID NO: 384)<br>(SEQ ID NO: 768)<br>(SEQ ID NO: 1152) |

TABLE 3

Selected Human Anti-transthyretin DsiRNAs, Unmodified Duplexes (Asymmetrics)

|  |  |  |
|---|---|---|
| TTR-27 | 5'-UGACUAAGUCAAUAAUCAGAAUCAG-3'<br>3'-CAACUGAUUCAGUUAUUAGUCUUAGUC-5'<br>Target: 5'-GTTGACTAAGTCAATAATCAGAATCAG-3' | (SEQ ID NO: 1153)<br>(SEQ ID NO: 385)<br>(SEQ ID NO: 769) |
| TTR-28 | 5'-GACUAAGUCAAUAAUCAGAAUCAGC-3'<br>3'-AACUGAUUCAGUUAUUAGUCUUAGUCG-5'<br>Target: 5'-TTGACTAAGTCAATAATCAGAATCAGC-3' | (SEQ ID NO: 1154)<br>(SEQ ID NO: 386)<br>(SEQ ID NO: 770) |
| TTR-29 | 5'-ACUAAGUCAAUAAUCAGAAUCAGCA-3'<br>3'-ACUGAUUCAGUUAUUAGUCUUAGUCGU-5'<br>Target: 5'-TGACTAAGTCAATAATCAGAATCAGCA-3' | (SEQ ID NO: 1155)<br>(SEQ ID NO: 387)<br>(SEQ ID NO: 771) |
| TTR-30 | 5'-CUAAGUCAAUAAUCAGAAUCAGCAG-3'<br>3'-CUGAUUCAGUUAUUAGUCUUAGUCGUC-5'<br>Target: 5'-GACTAAGTCAATAATCAGAATCAGCAG-3' | (SEQ ID NO: 1156)<br>(SEQ ID NO: 388)<br>(SEQ ID NO: 772) |
| TTR-31 | 5'-UAAGUCAAUAAUCAGAAUCAGCAGG-3'<br>3'-UGAUUCAGUUAUUAGUCUUAGUCGUCC-5'<br>Target: 5'-ACTAAGTCAATAATCAGAATCAGCAGG-3' | (SEQ ID NO: 1157)<br>(SEQ ID NO: 389)<br>(SEQ ID NO: 773) |
| TTR-32 | 5'-AAGUCAAUAAUCAGAAUCAGCAGGU-3'<br>3'-GAUUCAGUUAUUAGUCUUAGUCGUCCA-5'<br>Target: 5'-CTAAGTCAATAATCAGAATCAGCAGGT-3' | (SEQ ID NO: 1158)<br>(SEQ ID NO: 390)<br>(SEQ ID NO: 774) |
| TTR-33 | 5'-AGUCAAUAAUCAGAAUCAGCAGGUU-3'<br>3'-AUUCAGUUAUUAGUCUUAGUCGUCCAA-5'<br>Target: 5'-TAAGTCAATAATCAGAATCAGCAGGTT-3' | (SEQ ID NO: 1159)<br>(SEQ ID NO: 391)<br>(SEQ ID NO: 775) |
| TTR-34 | 5'-GUCAAUAAUCAGAAUCAGCAGGUUU-3'<br>3'-UUCAGUUAUUAGUCUUAGUCGUCCAAA-5'<br>Target: 5'-AAGTCAATAATCAGAATCAGCAGGTTT-3' | (SEQ ID NO: 1160)<br>(SEQ ID NO: 392)<br>(SEQ ID NO: 776) |
| TTR-35 | 5'-UCAAUAAUCAGAAUCAGCAGGUUUG-3'<br>3'-UCAGUUAUUAGUCUUAGUCGUCCAAAC-5'<br>Target: 5'-AGTCAATAATCAGAATCAGCAGGTTTG-3' | (SEQ ID NO: 1161)<br>(SEQ ID NO: 393)<br>(SEQ ID NO: 777) |
| TTR-36 | 5'-CAAUAAUCAGAAUCAGCAGGUUUGC-3'<br>3'-CAGUUAUUAGUCUUAGUCGUCCAAACG-5'<br>Target: 5'-GTCAATAATCAGAATCAGCAGGTTTGC-3' | (SEQ ID NO: 1162)<br>(SEQ ID NO: 394)<br>(SEQ ID NO: 778) |
| TTR-37 | 5'-AAUAAUCAGAAUCAGCAGGUUUGCA-3'<br>3'-AGUUAUUAGUCUUAGUCGUCCAAACGU-5'<br>Target: 5'-TCAATAATCAGAATCAGCAGGTTTGCA-3' | (SEQ ID NO: 1163)<br>(SEQ ID NO: 395)<br>(SEQ ID NO: 779) |
| TTR-38 | 5'-AUAAUCAGAAUCAGCAGGUUUGCAG-3'<br>3'-GUUAUUAGUCUUAGUCGUCCAAACGUC-5'<br>Target: 5'-CAATAATCAGAATCAGCAGGTTTGCAG-3' | (SEQ ID NO: 1164)<br>(SEQ ID NO: 396)<br>(SEQ ID NO: 780) |
| TTR-39 | 5'-UAAUCAGAAUCAGCAGGUUUGCAGU-3'<br>3'-UUAUUAGUCUUAGUCGUCCAAACGUCA-5'<br>Target: 5'-AATAATCAGAATCAGCAGGTTTGCAGT-3' | (SEQ ID NO: 1165)<br>(SEQ ID NO: 397)<br>(SEQ ID NO: 781) |
| TTR-40 | 5'-AAUCAGAAUCAGCAGGUUUGCAGUC-3'<br>3'-UAUUAGUCUUAGUCGUCCAAACGUCAG-5'<br>Target: 5'-ATAATCAGAATCAGCAGGTTTGCAGTC-3' | (SEQ ID NO: 1166)<br>(SEQ ID NO: 398)<br>(SEQ ID NO: 782) |

TABLE 3-continued

Selected Human Anti-transthyretin DsiRNAs, Unmodified Duplexes (Asymmetrics)

|  |  |  |
|---|---|---|
|  | 5'-AUCAGAAUCAGCAGGUUUGCAGUCA-3' | (SEQ ID NO: 1167) |
|  | 3'-AUUAGUCUUAGUCGUCCAAACGUCAGU-5' | (SEQ ID NO: 399) |
| TTR-41 Target: | 5'-TAATCAGAATCAGCAGGTTTGCAGTCA-3' | (SEQ ID NO: 783) |
|  | 5'-CAGAAUCAGCAGGUUUGCAGUCAGA-3' | (SEQ ID NO: 1168) |
|  | 3'-UAGUCUUAGUCGUCCAAACGUCAGUCU-5' | (SEQ ID NO: 400) |
| TTR-43 Target: | 5'-ATCAGAATCAGCAGGTTTGCAGTCAGA-3' | (SEQ ID NO: 784) |
|  | 5'-AGAAUCAGCAGGUUUGCAGUCAGAU-3' | (SEQ ID NO: 1169) |
|  | 3'-AGUCUUAGUCGUCCAAACGUCAGUCUA-5' | (SEQ ID NO: 401) |
| TTR-44 Target: | 5'-TCAGAATCAGCAGGTTTGCAGTCAGAT-3' | (SEQ ID NO: 785) |
|  | 5'-AAUCAGCAGGUUUGCAGUCAGAUUG-3' | (SEQ ID NO: 1170) |
|  | 3'-UCUUAGUCGUCCAAACGUCAGUCUAAC-5' | (SEQ ID NO: 402) |
| TTR-46 Target: | 5'-AGAATCAGCAGGTTTGCAGTCAGATTG-3' | (SEQ ID NO: 786) |
|  | 5'-AUCAGCAGGUUUGCAGUCAGAUUGG-3' | (SEQ ID NO: 1171) |
|  | 3'-CUUAGUCGUCCAAACGUCAGUCUAACC-5' | (SEQ ID NO: 403) |
| TTR-47 Target: | 5'-GAATCAGCAGGTTTGCAGTCAGATTGG-3' | (SEQ ID NO: 787) |
|  | 5'-GCAGUCAGAUUGGCAGGGAUAAGCA-3' | (SEQ ID NO: 1172) |
|  | 3'-AACGUCAGUCUAACCGUCCCUAUUCGU-5' | (SEQ ID NO: 404) |
| TTR-59 Target: | 5'-TTGCAGTCAGATTGGCAGGGATAAGCA-3' | (SEQ ID NO: 788) |
|  | 5'-GCCUAGCUCAGGAGAAGUGAGUAUA-3' | (SEQ ID NO: 1173) |
|  | 3'-GUCGGAUCGAGUCCUCUUCACUCAUAU-5' | (SEQ ID NO: 405) |
| TTR-84 Target: | 5'-CAGCCTAGCTCAGGAGAAGTGAGTATA-3' | (SEQ ID NO: 789) |
|  | 5'-UAGCUCAGGAGAAGUGAGUAUAAAA-3' | (SEQ ID NO: 1174) |
|  | 3'-GGAUCGAGUCCUCUUCACUCAUAUUUU-5' | (SEQ ID NO: 406) |
| TTR-87 Target: | 5'-CCTAGCTCAGGAGAAGTGAGTATAAAA-3' | (SEQ ID NO: 790) |
|  | 5'-AGCUCAGGAGAAGUGAGUAUAAAAG-3' | (SEQ ID NO: 1175) |
|  | 3'-GAUCGAGUCCUCUUCACUCAUAUUUUC-5' | (SEQ ID NO: 407) |
| TTR-88 Target: | 5'-CTAGCTCAGGAGAAGTGAGTATAAAAG-3' | (SEQ ID NO: 791) |
|  | 5'-GCUCAGGAGAAGUGAGUAUAAAAGC-3' | (SEQ ID NO: 1176) |
|  | 3'-AUCGAGUCCUCUUCACUCAUAUUUUCG-5' | (SEQ ID NO: 408) |
| TTR-89 Target: | 5'-TAGCTCAGGAGAAGTGAGTATAAAAGC-3' | (SEQ ID NO: 792) |
|  | 5'-CUCAGGAGAAGUGAGUAUAAAAGCC-3' | (SEQ ID NO: 1177) |
|  | 3'-UCGAGUCCUCUUCACUCAUAUUUUCGG-5' | (SEQ ID NO: 409) |
| TTR-90 Target: | 5'-AGCTCAGGAGAAGTGAGTATAAAAGCC-3' | (SEQ ID NO: 793) |
|  | 5'-CAGGAGAAGUGAGUAUAAAAGCCCC-3' | (SEQ ID NO: 1178) |
|  | 3'-GAGUCCUCUUCACUCAUAUUUUCGGGG-5' | (SEQ ID NO: 410) |
| TTR-92 Target: | 5'-CTCAGGAGAAGTGAGTATAAAAGCCCC-3' | (SEQ ID NO: 794) |
|  | 5'-GCAGCCAUCACAGAAGUCCACUCAU-3' | (SEQ ID NO: 1179) |
|  | 3'-CUCGUCGGUAGUGUCUUCAGGUGAGUA-5' | (SEQ ID NO: 411) |
| TTR-126 Target: | 5'-GAGCAGCCATCACAGAAGTCCACTCAT-3' | (SEQ ID NO: 795) |
|  | 5'-CAGCCAUCACAGAAGUCCACUCAUU-3' | (SEQ ID NO: 1180) |
|  | 3'-UCGUCGGUAGUGUCUUCAGGUGAGUAA-5' | (SEQ ID NO: 412) |
| TTR-127 Target: | 5'-AGCAGCCATCACAGAAGTCCACTCATT-3' | (SEQ ID NO: 796) |
|  | 5'-AGCCAUCACAGAAGUCCACUCAUUC-3' | (SEQ ID NO: 1181) |
|  | 3'-CGUCGGUAGUGUCUUCAGGUGAGUAAG-5' | (SEQ ID NO: 413) |
| TTR-128 Target: | 5'-GCAGCCATCACAGAAGTCCACTCATTC-3' | (SEQ ID NO: 797) |
|  | 5'-GCCAUCACAGAAGUCCACUCAUUCU-3' | (SEQ ID NO: 1182) |
|  | 3'-GUCGGUAGUGUCUUCAGGUGAGUAAGA-5' | (SEQ ID NO: 414) |
| TTR-129 Target: | 5'-CAGCCATCACAGAAGTCCACTCATTCT-3' | (SEQ ID NO: 798) |
|  | 5'-CCAUCACAGAAGUCCACUCAUUCUU-3' | (SEQ ID NO: 1183) |
|  | 3'-UCGGUAGUGUCUUCAGGUGAGUAAGAA-5' | (SEQ ID NO: 415) |
| TTR-130 Target: | 5'-AGCCATCACAGAAGTCCACTCATTCTT-3' | (SEQ ID NO: 799) |
|  | 5'-CAUCACAGAAGUCCACUCAUUCUUG-3' | (SEQ ID NO: 1184) |
|  | 3'-CGGUAGUGUCUUCAGGUGAGUAAGAAC-5' | (SEQ ID NO: 416) |
| TTR-131 Target: | 5'-GCCATCACAGAAGTCCACTCATTCTTG-3' | (SEQ ID NO: 800) |
|  | 5'-AUCACAGAAGUCCACUCAUUCUUGG-3' | (SEQ ID NO: 1185) |
|  | 3'-GGUAGUGUCUUCAGGUGAGUAAGAACC-5' | (SEQ ID NO: 417) |
| TTR-132 Target: | 5'-CCATCACAGAAGTCCACTCATTCTTGG-3' | (SEQ ID NO: 801) |

TABLE 3-continued

Selected Human Anti-transthyretin DsiRNAs, Unmodified Duplexes
(Asymmetrics)

|  |  |  |
|---|---|---|
| TTR-134 | 5'-CACAGAAGUCCACUCAUUCUUGGCA-3'<br>3'-UAGUGUCUUCAGGUGAGUAAGAACCGU-5'<br>Target: 5'-ATCACAGAAGTCCACTCATTCTTGGCA-3' | (SEQ ID NO: 1186)<br>(SEQ ID NO: 418)<br>(SEQ ID NO: 802) |
| TTR-135 | 5'-ACAGAAGUCCACUCAUUCUUGGCAG-3'<br>3'-AGUGUCUUCAGGUGAGUAAGAACCGUC-5'<br>Target: 5'-TCACAGAAGTCCACTCATTCTTGGCAG-3' | (SEQ ID NO: 1187)<br>(SEQ ID NO: 419)<br>(SEQ ID NO: 803) |
| TTR-150 | 5'-UUCUUGGCAGGAUGGCUUCUCAUCG-3'<br>3'-GUAAGAACCGUCCUACCGAAGAGUAGC-5'<br>Target: 5'-CATTCTTGGCAGGATGGCTTCTCATCG-3' | (SEQ ID NO: 1188)<br>(SEQ ID NO: 420)<br>(SEQ ID NO: 804) |
| TTR-151 | 5'-UCUUGGCAGGAUGGCUUCUCAUCGU-3'<br>3'-UAAGAACCGUCCUACCGAAGAGUAGCA-5'<br>Target: 5'-ATTCTTGGCAGGATGGCTTCTCATCGT-3' | (SEQ ID NO: 1189)<br>(SEQ ID NO: 421)<br>(SEQ ID NO: 805) |
| TTR-152 | 5'-CUUGGCAGGAUGGCUUCUCAUCGUC-3'<br>3'-AAGAACCGUCCUACCGAAGAGUAGCAG-5'<br>Target: 5'-TTCTTGGCAGGATGGCTTCTCATCGTC-3' | (SEQ ID NO: 1190)<br>(SEQ ID NO: 422)<br>(SEQ ID NO: 806) |
| TTR-153 | 5'-UUGGCAGGAUGGCUUCUCAUCGUCU-3'<br>3'-AGAACCGUCCUACCGAAGAGUAGCAGA-5'<br>Target: 5'-TCTTGGCAGGATGGCTTCTCATCGTCT-3' | (SEQ ID NO: 1191)<br>(SEQ ID NO: 423)<br>(SEQ ID NO: 807) |
| TTR-154 | 5'-UGGCAGGAUGGCUUCUCAUCGUCUG-3'<br>3'-GAACCGUCCUACCGAAGAGUAGCAGAC-5'<br>Target: 5'-CTTGGCAGGATGGCTTCTCATCGTCTG-3' | (SEQ ID NO: 1192)<br>(SEQ ID NO: 424)<br>(SEQ ID NO: 808) |
| TTR-155 | 5'-GGCAGGAUGGCUUCUCAUCGUCUGC-3'<br>3'-AACCGUCCUACCGAAGAGUAGCAGACG-5'<br>Target: 5'-TTGGCAGGATGGCTTCTCATCGTCTGC-3' | (SEQ ID NO: 1193)<br>(SEQ ID NO: 425)<br>(SEQ ID NO: 809) |
| TTR-156 | 5'-GCAGGAUGGCUUCUCAUCGUCUGCU-3'<br>3'-ACCGUCCUACCGAAGAGUAGCAGACGA-5'<br>Target: 5'-TGGCAGGATGGCTTCTCATCGTCTGCT-3' | (SEQ ID NO: 1194)<br>(SEQ ID NO: 426)<br>(SEQ ID NO: 810) |
| TTR-157 | 5'-CAGGAUGGCUUCUCAUCGUCUGCUC-3'<br>3'-CCGUCCUACCGAAGAGUAGCAGACGAG-5'<br>Target: 5'-GGCAGGATGGCTTCTCATCGTCTGCTC-3' | (SEQ ID NO: 1195)<br>(SEQ ID NO: 427)<br>(SEQ ID NO: 811) |
| TTR-158 | 5'-AGGAUGGCUUCUCAUCGUCUGCUCC-3'<br>3'-CGUCCUACCGAAGAGUAGCAGACGAGG-5'<br>Target: 5'-GCAGGATGGCTTCTCATCGTCTGCTCC-3' | (SEQ ID NO: 1196)<br>(SEQ ID NO: 428)<br>(SEQ ID NO: 812) |
| TTR-159 | 5'-GGAUGGCUUCUCAUCGUCUGCUCCU-3'<br>3'-GUCCUACCGAAGAGUAGCAGACGAGGA-5'<br>Target: 5'-CAGGATGGCTTCTCATCGTCTGCTCCT-3' | (SEQ ID NO: 1197)<br>(SEQ ID NO: 429)<br>(SEQ ID NO: 813) |
| TTR-160 | 5'-GAUGGCUUCUCAUCGUCUGCUCCUC-3'<br>3'-UCCUACCGAAGAGUAGCAGACGAGGAG-5'<br>Target: 5'-AGGATGGCTTCTCATCGTCTGCTCCTC-3' | (SEQ ID NO: 1198)<br>(SEQ ID NO: 430)<br>(SEQ ID NO: 814) |
| TTR-161 | 5'-AUGGCUUCUCAUCGUCUGCUCCUCC-3'<br>3'-CCUACCGAAGAGUAGCAGACGAGGAGG-5'<br>Target: 5'-GGATGGCTTCTCATCGTCTGCTCCTCC-3' | (SEQ ID NO: 1199)<br>(SEQ ID NO: 431)<br>(SEQ ID NO: 815) |
| TTR-162 | 5'-UGGCUUCUCAUCGUCUGCUCCUCCU-3'<br>3'-CUACCGAAGAGUAGCAGACGAGGAGGA-5'<br>Target: 5'-GATGGCTTCTCATCGTCTGCTCCTCCT-3' | (SEQ ID NO: 1200)<br>(SEQ ID NO: 432)<br>(SEQ ID NO: 816) |
| TTR-163 | 5'-GGCUUCUCAUCGUCUGCUCCUCCUC-3'<br>3'-UACCGAAGAGUAGCAGACGAGGAGGAG-5'<br>Target: 5'-ATGGCTTCTCATCGTCTGCTCCTCCTC-3' | (SEQ ID NO: 1201)<br>(SEQ ID NO: 433)<br>(SEQ ID NO: 817) |
| TTR-164 | 5'-GCUUCUCAUCGUCUGCUCCUCCUCU-3'<br>3'-ACCGAAGAGUAGCAGACGAGGAGGAGA-5'<br>Target: 5'-TGGCTTCTCATCGTCTGCTCCTCCTCT-3' | (SEQ ID NO: 1202)<br>(SEQ ID NO: 434)<br>(SEQ ID NO: 818) |
| TTR-165 | 5'-CUUCUCAUCGUCUGCUCCUCCUCUG-3'<br>3'-CCGAAGAGUAGCAGACGAGGAGGAGAC-5'<br>Target: 5'-GGCTTCTCATCGTCTGCTCCTCCTCTG-3' | (SEQ ID NO: 1203)<br>(SEQ ID NO: 435)<br>(SEQ ID NO: 819) |
| TTR-186 | 5'-UCUGCCUUGCUGGACUGGUAUUUGU-3'<br>3'-GGAGACGGAACGACCUGACCAUAAACA-5'<br>Target: 5'-CCTCTGCCTTGCTGGACTGGTATTTGT-3' | (SEQ ID NO: 1204)<br>(SEQ ID NO: 436)<br>(SEQ ID NO: 820) |

TABLE 3-continued

Selected Human Anti-transthyretin DsiRNAs, Unmodified Duplexes
(Asymmetrics)

|  |  |  |  |
|---|---|---|---|
| TTR-187 Target: | 5'-CUGCCUUGCUGGACUGGUAUUUGUG-3'<br>3'-GAGACGGAACGACCUGACCAUAAACAC-5'<br>5'-CTCTGCCTTGCTGGACTGGTATTTGTG-3' | (SEQ ID NO: 1205)<br>(SEQ ID NO: 437)<br>(SEQ ID NO: 821) |  |
| TTR-234 Target: | 5'-CCGGUGAAUCCAAGUGUCCUCUGAU-3'<br>3'-GUGGCCACUUAGGUUCACAGGAGACUA-5'<br>5'-CACCGGTGAATCCAAGTGTCCTCTGAT-3' | (SEQ ID NO: 1206)<br>(SEQ ID NO: 438)<br>(SEQ ID NO: 822) |  |
| TTR-238 Target: | 5'-UGAAUCCAAGUGUCCUCUGAUGGUC-3'<br>3'-CCACUUAGGUUCACAGGAGACUACCAG-5'<br>5'-GGTGAATCCAAGTGTCCTCTGATGGTC-3' | (SEQ ID NO: 1207)<br>(SEQ ID NO: 439)<br>(SEQ ID NO: 823) |  |
| TTR-239 Target: | 5'-GAAUCCAAGUGUCCUCUGAUGGUCA-3'<br>3'-CACUUAGGUUCACAGGAGACUACCAGU-5'<br>5'-GTGAATCCAAGTGTCCTCTGATGGTCA-3' | (SEQ ID NO: 1208)<br>(SEQ ID NO: 440)<br>(SEQ ID NO: 824) |  |
| TTR-240 Target: | 5'-AAUCCAAGUGUCCUCUGAUGGUCAA-3'<br>3'-ACUUAGGUUCACAGGAGACUACCAGUU-5'<br>5'-TGAATCCAAGTGTCCTCTGATGGTCAA-3' | (SEQ ID NO: 1209)<br>(SEQ ID NO: 441)<br>(SEQ ID NO: 825) |  |
| TTR-241 Target: | 5'-AUCCAAGUGUCCUCUGAUGGUCAAA-3'<br>3'-CUUAGGUUCACAGGAGACUACCAGUUU-5'<br>5'-GAATCCAAGTGTCCTCTGATGGTCAAA-3' | (SEQ ID NO: 1210)<br>(SEQ ID NO: 442)<br>(SEQ ID NO: 826) |  |
| TTR-242 Target: | 5'-UCCAAGUGUCCUCUGAUGGUCAAAG-3'<br>3'-UUAGGUUCACAGGAGACUACCAGUUUC-5'<br>5'-AATCCAAGTGTCCTCTGATGGTCAAAG-3' | (SEQ ID NO: 1211)<br>(SEQ ID NO: 443)<br>(SEQ ID NO: 827) |  |
| TTR-243 Target: | 5'-CCAAGUGUCCUCUGAUGGUCAAAGU-3'<br>3'-UAGGUUCACAGGAGACUACCAGUUUCA-5'<br>5'-ATCCAAGTGTCCTCTGATGGTCAAAGT-3' | (SEQ ID NO: 1212)<br>(SEQ ID NO: 444)<br>(SEQ ID NO: 828) |  |
| TTR-244 Target: | 5'-CAAGUGUCCUCUGAUGGUCAAAGUU-3'<br>3'-AGGUUCACAGGAGACUACCAGUUUCAA-5'<br>5'-TCCAAGTGTCCTCTGATGGTCAAAGTT-3' | (SEQ ID NO: 1213)<br>(SEQ ID NO: 445)<br>(SEQ ID NO: 829) |  |
| TTR-245 Target: | 5'-AAGUGUCCUCUGAUGGUCAAAGUUC-3'<br>3'-GGUUCACAGGAGACUACCAGUUUCAAG-5'<br>5'-CCAAGTGTCCTCTGATGGTCAAAGTTC-3' | (SEQ ID NO: 1214)<br>(SEQ ID NO: 446)<br>(SEQ ID NO: 830) |  |
| TTR-246 Target: | 5'-AGUGUCCUCUGAUGGUCAAAGUUCU-3'<br>3'-GUUCACAGGAGACUACCAGUUUCAAGA-5'<br>5'-CAAGTGTCCTCTGATGGTCAAAGTTCT-3' | (SEQ ID NO: 1215)<br>(SEQ ID NO: 447)<br>(SEQ ID NO: 831) |  |
| TTR-247 Target: | 5'-GUGUCCUCUGAUGGUCAAAGUUCUA-3'<br>3'-UUCACAGGAGACUACCAGUUUCAAGAU-5'<br>5'-AAGTGTCCTCTGATGGTCAAAGTTCTA-3' | (SEQ ID NO: 1216)<br>(SEQ ID NO: 448)<br>(SEQ ID NO: 832) |  |
| TTR-248 Target: | 5'-UGUCCUCUGAUGGUCAAAGUUCUAG-3'<br>3'-UCACAGGAGACUACCAGUUUCAAGAUC-5'<br>5'-AGTGTCCTCTGATGGTCAAAGTTCTAG-3' | (SEQ ID NO: 1217)<br>(SEQ ID NO: 449)<br>(SEQ ID NO: 833) |  |
| TTR-249 Target: | 5'-GUCCUCUGAUGGUCAAAGUUCUAGA-3'<br>3'-CACAGGAGACUACCAGUUUCAAGAUCU-5'<br>5'-GTGTCCTCTGATGGTCAAAGTTCTAGA-3' | (SEQ ID NO: 1218)<br>(SEQ ID NO: 450)<br>(SEQ ID NO: 834) |  |
| TTR-250 Target: | 5'-UCCUCUGAUGGUCAAAGUUCUAGAU-3'<br>3'-ACAGGAGACUACCAGUUUCAAGAUCUA-5'<br>5'-TGTCCTCTGATGGTCAAAGTTCTAGAT-3' | (SEQ ID NO: 1219)<br>(SEQ ID NO: 451)<br>(SEQ ID NO: 835) |  |
| TTR-251 Target: | 5'-CCUCUGAUGGUCAAAGUUCUAGAUG-3'<br>3'-CAGGAGACUACCAGUUUCAAGAUCUAC-5'<br>5'-GTCCTCTGATGGTCAAAGTTCTAGATG-3' | (SEQ ID NO: 1220)<br>(SEQ ID NO: 452)<br>(SEQ ID NO: 836) |  |
| TTR-252 Target: | 5'-CUCUGAUGGUCAAAGUUCUAGAUGC-3'<br>3'-AGGAGACUACCAGUUUCAAGAUCUACG-5'<br>5'-TCCTCTGATGGTCAAAGTTCTAGATGC-3' | (SEQ ID NO: 1221)<br>(SEQ ID NO: 453)<br>(SEQ ID NO: 837) |  |
| TTR-253 Target: | 5'-UCUGAUGGUCAAAGUUCUAGAUGCU-3'<br>3'-GGAGACUACCAGUUUCAAGAUCUACGA-5'<br>5'-CCTCTGATGGTCAAAGTTCTAGATGCT-3' | (SEQ ID NO: 1222)<br>(SEQ ID NO: 454)<br>(SEQ ID NO: 838) |  |
| TTR-254 Target: | 5'-CUGAUGGUCAAAGUUCUAGAUGCUG-3'<br>3'-GAGACUACCAGUUUCAAGAUCUACGAC-5'<br>5'-CTCTGATGGTCAAAGTTCTAGATGCTG-3' | (SEQ ID NO: 1223)<br>(SEQ ID NO: 455)<br>(SEQ ID NO: 839) |  |

TABLE 3-continued

Selected Human Anti-transthyretin DsiRNAs, Unmodified Duplexes (Asymmetrics)

|  |  |  |
|---|---|---|
|  | 5'-UGAUGGUCAAAGUUCUAGAUGCUGU-3' | (SEQ ID NO: 1224) |
|  | 3'-AGACUACCAGUUUCAAGAUCUACGACA-5' | (SEQ ID NO: 456) |
| TTR-255 Target: | 5'-TCTGATGGTCAAAGTTCTAGATGCTGT-3' | (SEQ ID NO: 840) |
|  | 5'-GAUGGUCAAAGUUCUAGAUGCUGUC-3' | (SEQ ID NO: 1225) |
|  | 3'-GACUACCAGUUUCAAGAUCUACGACAG-5' | (SEQ ID NO: 457) |
| TTR-256 Target: | 5'-CTGATGGTCAAAGTTCTAGATGCTGTC-3' | (SEQ ID NO: 841) |
|  | 5'-AUGGUCAAAGUUCUAGAUGCUGUCC-3' | (SEQ ID NO: 1226) |
|  | 3'-ACUACCAGUUUCAAGAUCUACGACAGG-5' | (SEQ ID NO: 458) |
| TTR-257 Target: | 5'-TGATGGTCAAAGTTCTAGATGCTGTCC-3' | (SEQ ID NO: 842) |
|  | 5'-UGGUCAAAGUUCUAGAUGCUGUCCG-3' | (SEQ ID NO: 1227) |
|  | 3'-CUACCAGUUUCAAGAUCUACGACAGGC-5' | (SEQ ID NO: 459) |
| TTR-258 Target: | 5'-GATGGTCAAAGTTCTAGATGCTGTCCG-3' | (SEQ ID NO: 843) |
|  | 5'-GCCAUUUGCCUCUGGGAAAACCAGU-3' | (SEQ ID NO: 1228) |
|  | 3'-CUCGGUAAACGGAGACCCUUUUGGUCA-5' | (SEQ ID NO: 460) |
| TTR-346 Target: | 5'-GAGCCATTTGCCTCTGGGAAAACCAGT-3' | (SEQ ID NO: 844) |
|  | 5'-CCAUUUGCCUCUGGGAAAACCAGUG-3' | (SEQ ID NO: 1229) |
|  | 3'-UCGGUAAACGGAGACCCUUUUGGUCAC-5' | (SEQ ID NO: 461) |
| TTR-347 Target: | 5'-AGCCATTTGCCTCTGGGAAAACCAGTG-3' | (SEQ ID NO: 845) |
|  | 5'-CAUUUGCCUCUGGGAAAACCAGUGA-3' | (SEQ ID NO: 1230) |
|  | 3'-CGGUAAACGGAGACCCUUUUGGUCACU-5' | (SEQ ID NO: 462) |
| TTR-348 Target: | 5'-GCCATTTGCCTCTGGGAAAACCAGTGA-3' | (SEQ ID NO: 846) |
|  | 5'-AUUUGCCUCUGGGAAAACCAGUGAG-3' | (SEQ ID NO: 1231) |
|  | 3'-GGUAAACGGAGACCCUUUUGGUCACUC-5' | (SEQ ID NO: 463) |
| TTR-349 Target: | 5'-CCATTTGCCTCTGGGAAAACCAGTGAG-3' | (SEQ ID NO: 847) |
|  | 5'-UUUGCCUCUGGGAAAACCAGUGAGU-3' | (SEQ ID NO: 1232) |
|  | 3'-GUAAACGGAGACCCUUUUGGUCACUCA-5' | (SEQ ID NO: 464) |
| TTR-350 Target: | 5'-CATTTGCCTCTGGGAAAACCAGTGAGT-3' | (SEQ ID NO: 848) |
|  | 5'-UUGCCUCUGGGAAAACCAGUGAGUC-3' | (SEQ ID NO: 1233) |
|  | 3'-UAAACGGAGACCCUUUUGGUCACUCAG-5' | (SEQ ID NO: 465) |
| TTR-351 Target: | 5'-ATTTGCCTCTGGGAAAACCAGTGAGTC-3' | (SEQ ID NO: 849) |
|  | 5'-UGCCUCUGGGAAAACCAGUGAGUCU-3' | (SEQ ID NO: 1234) |
|  | 3'-AAACGGAGACCCUUUUGGUCACUCAGA-5' | (SEQ ID NO: 466) |
| TTR-352 Target: | 5'-TTTGCCTCTGGGAAAACCAGTGAGTCT-3' | (SEQ ID NO: 850) |
|  | 5'-GCCUCUGGGAAAACCAGUGAGUCUG-3' | (SEQ ID NO: 1235) |
|  | 3'-AACGGAGACCCUUUUGGUCACUCAGAC-5' | (SEQ ID NO: 467) |
| TTR-353 Target: | 5'-TTGCCTCTGGGAAAACCAGTGAGTCTG-3' | (SEQ ID NO: 851) |
|  | 5'-CCUCUGGGAAAACCAGUGAGUCUGG-3' | (SEQ ID NO: 1236) |
|  | 3'-ACGGAGACCCUUUUGGUCACUCAGACC-5' | (SEQ ID NO: 468) |
| TTR-354 Target: | 5'-TGCCTCTGGGAAAACCAGTGAGTCTGG-3' | (SEQ ID NO: 852) |
|  | 5'-CUCUGGGAAAACCAGUGAGUCUGGA-3' | (SEQ ID NO: 1237) |
|  | 3'-CGGAGACCCUUUUGGUCACUCAGACCU-5' | (SEQ ID NO: 469) |
| TTR-355 Target: | 5'-GCCTCTGGGAAAACCAGTGAGTCTGGA-3' | (SEQ ID NO: 853) |
|  | 5'-UCUGGGAAAACCAGUGAGUCUGGAG-3' | (SEQ ID NO: 1238) |
|  | 3'-GGAGACCCUUUUGGUCACUCAGACCUC-5' | (SEQ ID NO: 470) |
| TTR-356 Target: | 5'-CCTCTGGGAAAACCAGTGAGTCTGGAG-3' | (SEQ ID NO: 854) |
|  | 5'-CUGGGAAAACCAGUGAGUCUGGAGA-3' | (SEQ ID NO: 1239) |
|  | 3'-GAGACCCUUUUGGUCACUCAGACCUCU-5' | (SEQ ID NO: 471) |
| TTR-357 Target: | 5'-CTCTGGGAAAACCAGTGAGTCTGGAGA-3' | (SEQ ID NO: 855) |
|  | 5'-UGGGAAAACCAGUGAGUCUGGAGAG-3' | (SEQ ID NO: 1240) |
|  | 3'-AGACCCUUUUGGUCACUCAGACCUCUC-5' | (SEQ ID NO: 472) |
| TTR-358 Target: | 5'-TCTGGGAAAACCAGTGAGTCTGGAGAG-3' | (SEQ ID NO: 856) |
|  | 5'-GGGAAAACCAGUGAGUCUGGAGAGC-3' | (SEQ ID NO: 1241) |
|  | 3'-GACCCUUUUGGUCACUCAGACCUCUCG-5' | (SEQ ID NO: 473) |
| TTR-359 Target: | 5'-CTGGGAAAACCAGTGAGTCTGGAGAGC-3' | (SEQ ID NO: 857) |
|  | 5'-GGAAAACCAGUGAGUCUGGAGAGCU-3' | (SEQ ID NO: 1242) |
|  | 3'-ACCCUUUUGGUCACUCAGACCUCUCGA-5' | (SEQ ID NO: 474) |
| TTR-360 Target: | 5'-TGGGAAAACCAGTGAGTCTGGAGAGCT-3' | (SEQ ID NO: 858) |

TABLE 3-continued

Selected Human Anti-transthyretin DsiRNAs, Unmodified Duplexes (Asymmetrics)

|  |  |  |
|---|---|---|
| TTR-361 Target: | 5'-GAAAACCAGUGAGUCUGGAGAGCUG-3'<br>3'-CCCUUUUGGUCACUCAGACCUCUCGAC-5'<br>5'-GGGAAAACCAGTGAGTCTGGAGAGCTG-3' | (SEQ ID NO: 1243)<br>(SEQ ID NO: 475)<br>(SEQ ID NO: 859) |
| TTR-381 Target: | 5'-AGCUGCAUGGGCUCACAACUGAGGA-3'<br>3'-UCUCGACGUACCCGAGUGUUGACUCCU-5'<br>5'-AGAGCTGCATGGGCTCACAACTGAGGA-3' | (SEQ ID NO: 1244)<br>(SEQ ID NO: 476)<br>(SEQ ID NO: 860) |
| TTR-382 Target: | 5'-GCUGCAUGGGCUCACAACUGAGGAG-3'<br>3'-CUCGACGUACCCGAGUGUUGACUCCUC-5'<br>5'-GAGCTGCATGGGCTCACAACTGAGGAG-3' | (SEQ ID NO: 1245)<br>(SEQ ID NO: 477)<br>(SEQ ID NO: 861) |
| TTR-383 Target: | 5'-CUGCAUGGGCUCACAACUGAGGAGG-3'<br>3'-UCGACGUACCCGAGUGUUGACUCCUCC-5'<br>5'-AGCTGCATGGGCTCACAACTGAGGAGG-3' | (SEQ ID NO: 1246)<br>(SEQ ID NO: 478)<br>(SEQ ID NO: 862) |
| TTR-384 Target: | 5'-UGCAUGGGCUCACAACUGAGGAGGA-3'<br>3'-CGACGUACCCGAGUGUUGACUCCUCCU-5'<br>5'-GCTGCATGGGCTCACAACTGAGGAGGA-3' | (SEQ ID NO: 1247)<br>(SEQ ID NO: 479)<br>(SEQ ID NO: 863) |
| TTR-385 Target: | 5'-GCAUGGGCUCACAACUGAGGAGGAA-3'<br>3'-GACGUACCCGAGUGUUGACUCCUCCUU-5'<br>5'-CTGCATGGGCTCACAACTGAGGAGGAA-3' | (SEQ ID NO: 1248)<br>(SEQ ID NO: 480)<br>(SEQ ID NO: 864) |
| TTR-386 Target: | 5'-CAUGGGCUCACAACUGAGGAGGAAU-3'<br>3'-ACGUACCCGAGUGUUGACUCCUCCUUA-5'<br>5'-TGCATGGGCTCACAACTGAGGAGGAAT-3' | (SEQ ID NO: 1249)<br>(SEQ ID NO: 481)<br>(SEQ ID NO: 865) |
| TTR-387 Target: | 5'-AUGGGCUCACAACUGAGGAGGAAUU-3'<br>3'-CGUACCCGAGUGUUGACUCCUCCUUAA-5'<br>5'-GCATGGGCTCACAACTGAGGAGGAATT-3' | (SEQ ID NO: 1250)<br>(SEQ ID NO: 482)<br>(SEQ ID NO: 866) |
| TTR-388 Target: | 5'-UGGGCUCACAACUGAGGAGGAAUUU-3'<br>3'-GUACCCGAGUGUUGACUCCUCCUUAAA-5'<br>5'-CATGGGCTCACAACTGAGGAGGAATTT-3' | (SEQ ID NO: 1251)<br>(SEQ ID NO: 483)<br>(SEQ ID NO: 867) |
| TTR-389 Target: | 5'-GGGCUCACAACUGAGGAGGAAUUUG-3'<br>3'-UACCCGAGUGUUGACUCCUCCUUAAAC-5'<br>5'-ATGGGCTCACAACTGAGGAGGAATTTG-3' | (SEQ ID NO: 1252)<br>(SEQ ID NO: 484)<br>(SEQ ID NO: 868) |
| TTR-390 Target: | 5'-GGCUCACAACUGAGGAGGAAUUUGU-3'<br>3'-ACCCGAGUGUUGACUCCUCCUUAAACA-5'<br>5'-TGGGCTCACAACTGAGGAGGAATTTGT-3' | (SEQ ID NO: 1253)<br>(SEQ ID NO: 485)<br>(SEQ ID NO: 869) |
| TTR-391 Target: | 5'-GCUCACAACUGAGGAGGAAUUUGUA-3'<br>3'-CCCGAGUGUUGACUCCUCCUUAAACAU-5'<br>5'-GGGCTCACAACTGAGGAGGAATTTGTA-3' | (SEQ ID NO: 1254)<br>(SEQ ID NO: 486)<br>(SEQ ID NO: 870) |
| TTR-392 Target: | 5'-CUCACAACUGAGGAGGAAUUUGUAG-3'<br>3'-CCGAGUGUUGACUCCUCCUUAAACAUC-5'<br>5'-GGCTCACAACTGAGGAGGAATTTGTAG-3' | (SEQ ID NO: 1255)<br>(SEQ ID NO: 487)<br>(SEQ ID NO: 871) |
| TTR-393 Target: | 5'-UCACAACUGAGGAGGAAUUUGUAGA-3'<br>3'-CGAGUGUUGACUCCUCCUUAAACAUCU-5'<br>5'-GCTCACAACTGAGGAGGAATTTGTAGA-3' | (SEQ ID NO: 1256)<br>(SEQ ID NO: 488)<br>(SEQ ID NO: 872) |
| TTR-394 Target: | 5'-CACAACUGAGGAGGAAUUUGUAGAA-3'<br>3'-GAGUGUUGACUCCUCCUUAAACAUCUU-5'<br>5'-CTCACAACTGAGGAGGAATTTGTAGAA-3' | (SEQ ID NO: 1257)<br>(SEQ ID NO: 489)<br>(SEQ ID NO: 873) |
| TTR-395 Target: | 5'-ACAACUGAGGAGGAAUUUGUAGAAG-3'<br>3'-AGUGUUGACUCCUCCUUAAACAUCUUC-5'<br>5'-TCACAACTGAGGAGGAATTTGTAGAAG-3' | (SEQ ID NO: 1258)<br>(SEQ ID NO: 490)<br>(SEQ ID NO: 874) |
| TTR-396 Target: | 5'-CAACUGAGGAGGAAUUUGUAGAAGG-3'<br>3'-GUGUUGACUCCUCCUUAAACAUCUUCC-5'<br>5'-CACAACTGAGGAGGAATTTGTAGAAGG-3' | (SEQ ID NO: 1259)<br>(SEQ ID NO: 491)<br>(SEQ ID NO: 875) |
| TTR-398 Target: | 5'-ACUGAGGAGGAAUUUGUAGAAGGGA-3'<br>3'-GUUGACUCCUCCUUAAACAUCUUCCCU-5'<br>5'-CAACTGAGGAGGAATTTGTAGAAGGGA-3' | (SEQ ID NO: 1260)<br>(SEQ ID NO: 492)<br>(SEQ ID NO: 876) |
| TTR-399 Target: | 5'-CUGAGGAGGAAUUUGUAGAAGGGAU-3'<br>3'-UUGACUCCUCCUUAAACAUCUUCCCUA-5'<br>5'-AACTGAGGAGGAATTTGTAGAAGGGAT-3' | (SEQ ID NO: 1261)<br>(SEQ ID NO: 493)<br>(SEQ ID NO: 877) |

TABLE 3-continued

Selected Human Anti-transthyretin DsiRNAs, Unmodified Duplexes
(Asymmetrics)

| | | |
|---|---|---|
| TTR-400 Target: | 5'-UGAGGAGGAAUUUGUAGAAGGGAUA-3'<br>3'-UGACUCCUCCUUAAACAUCUUCCCUAU-5'<br>5'-ACTGAGGAGGAATTTGTAGAAGGGATA-3' | (SEQ ID NO: 1262)<br>(SEQ ID NO: 494)<br>(SEQ ID NO: 878) |
| TTR-401 Target: | 5'-GAGGAGGAAUUUGUAGAAGGGAUAU-3'<br>3'-GACUCCUCCUUAAACAUCUUCCCUAUA-5'<br>5'-CTGAGGAGGAATTTGTAGAAGGGATAT-3' | (SEQ ID NO: 1263)<br>(SEQ ID NO: 495)<br>(SEQ ID NO: 879) |
| TTR-402 Target: | 5'-AGGAGGAAUUUGUAGAAGGGAUAUA-3'<br>3'-ACUCCUCCUUAAACAUCUUCCCUAUAU-5'<br>5'-TGAGGAGGAATTTGTAGAAGGGATATA-3' | (SEQ ID NO: 1264)<br>(SEQ ID NO: 496)<br>(SEQ ID NO: 880) |
| TTR-403 Target: | 5'-GGAGGAAUUUGUAGAAGGGAUAUAC-3'<br>3'-CUCCUCCUUAAACAUCUUCCCUAUAUG-5'<br>5'-GAGGAGGAATTTGTAGAAGGGATATAC-3' | (SEQ ID NO: 1265)<br>(SEQ ID NO: 497)<br>(SEQ ID NO: 881) |
| TTR-404 Target: | 5'-GAGGAAUUUGUAGAAGGGAUAUACA-3'<br>3'-UCCUCCUUAAACAUCUUCCCUAUAUGU-5'<br>5'-AGGAGGAATTTGTAGAAGGGATATACA-3' | (SEQ ID NO: 1266)<br>(SEQ ID NO: 498)<br>(SEQ ID NO: 882) |
| TTR-405 Target: | 5'-AGGAAUUUGUAGAAGGGAUAUACAA-3'<br>3'-CCUCCUUAAACAUCUUCCCUAUAUGUU-5'<br>5'-GGAGGAATTTGTAGAAGGGATATACAA-3' | (SEQ ID NO: 1267)<br>(SEQ ID NO: 499)<br>(SEQ ID NO: 883) |
| TTR-406 Target: | 5'-GGAAUUUGUAGAAGGGAUAUACAAA-3'<br>3'-CUCCUUAAACAUCUUCCCUAUAUGUUU-5'<br>5'-GAGGAATTTGTAGAAGGGATATACAAA-3' | (SEQ ID NO: 1268)<br>(SEQ ID NO: 500)<br>(SEQ ID NO: 884) |
| TTR-407 Target: | 5'-GAAUUUGUAGAAGGGAUAUACAAAG-3'<br>3'-UCCUUAAACAUCUUCCCUAUAUGUUUC-5'<br>5'-AGGAATTTGTAGAAGGGATATACAAAG-3' | (SEQ ID NO: 1269)<br>(SEQ ID NO: 501)<br>(SEQ ID NO: 885) |
| TTR-408 Target: | 5'-AAUUUGUAGAAGGGAUAUACAAAGU-3'<br>3'-CCUUAAACAUCUUCCCUAUAUGUUUCA-5'<br>5'-GGAATTTGTAGAAGGGATATACAAAGT-3' | (SEQ ID NO: 1270)<br>(SEQ ID NO: 502)<br>(SEQ ID NO: 886) |
| TTR-409 Target: | 5'-AUUUGUAGAAGGGAUAUACAAAGUG-3'<br>3'-CUUAAACAUCUUCCCUAUAUGUUUCAC-5'<br>5'-GAATTTGTAGAAGGGATATACAAAGTG-3' | (SEQ ID NO: 1271)<br>(SEQ ID NO: 503)<br>(SEQ ID NO: 887) |
| TTR-410 Target: | 5'-UUUGUAGAAGGGAUAUACAAAGUGG-3'<br>3'-UUAAACAUCUUCCCUAUAUGUUUCACC-5'<br>5'-AATTTGTAGAAGGGATATACAAAGTGG-3' | (SEQ ID NO: 1272)<br>(SEQ ID NO: 504)<br>(SEQ ID NO: 888) |
| TTR-411 Target: | 5'-UUGUAGAAGGGAUAUACAAAGUGGA-3'<br>3'-UAAACAUCUUCCCUAUAUGUUUCACCU-5'<br>5'-ATTTGTAGAAGGGATATACAAAGTGGA-3' | (SEQ ID NO: 1273)<br>(SEQ ID NO: 505)<br>(SEQ ID NO: 889) |
| TTR-412 Target: | 5'-UGUAGAAGGGAUAUACAAAGUGGAA-3'<br>3'-AAACAUCUUCCCUAUAUGUUUCACCUU-5'<br>5'-TTTGTAGAAGGGATATACAAAGTGGAA-3' | (SEQ ID NO: 1274)<br>(SEQ ID NO: 506)<br>(SEQ ID NO: 890) |
| TTR-413 Target: | 5'-GUAGAAGGGAUAUACAAAGUGGAAA-3'<br>3'-AACAUCUUCCCUAUAUGUUUCACCUUU-5'<br>5'-TTGTAGAAGGGATATACAAAGTGGAAA-3' | (SEQ ID NO: 1275)<br>(SEQ ID NO: 507)<br>(SEQ ID NO: 891) |
| TTR-414 Target: | 5'-UAGAAGGGAUAUACAAAGUGGAAAU-3'<br>3'-ACAUCUUCCCUAUAUGUUUCACCUUUA-5'<br>5'-TGTAGAAGGGATATACAAAGTGGAAAT-3' | (SEQ ID NO: 1276)<br>(SEQ ID NO: 508)<br>(SEQ ID NO: 892) |
| TTR-415 Target: | 5'-AGAAGGGAUAUACAAAGUGGAAAUA-3'<br>3'-CAUCUUCCCUAUAUGUUUCACCUUUAU-5'<br>5'-GTAGAAGGGATATACAAAGTGGAAATA-3' | (SEQ ID NO: 1277)<br>(SEQ ID NO: 509)<br>(SEQ ID NO: 893) |
| TTR-416 Target: | 5'-GAAGGGAUAUACAAAGUGGAAAUAG-3'<br>3'-AUCUUCCCUAUAUGUUUCACCUUUAUC-5'<br>5'-TAGAAGGGATATACAAAGTGGAAATAG-3' | (SEQ ID NO: 1278)<br>(SEQ ID NO: 510)<br>(SEQ ID NO: 894) |
| TTR-417 Target: | 5'-AAGGGAUAUACAAAGUGGAAAUAGA-3'<br>3'-UCUUCCCUAUAUGUUUCACCUUUAUCU-5'<br>5'-AGAAGGGATATACAAAGTGGAAATAGA-3' | (SEQ ID NO: 1279)<br>(SEQ ID NO: 511)<br>(SEQ ID NO: 895) |
| TTR-418 Target: | 5'-AGGGAUAUACAAAGUGGAAAUAGAC-3'<br>3'-CUUCCCUAUAUGUUUCACCUUUAUCUG-5'<br>5'-GAAGGGATATACAAAGTGGAAATAGAC-3' | (SEQ ID NO: 1280)<br>(SEQ ID NO: 512)<br>(SEQ ID NO: 896) |

TABLE 3-continued

Selected Human Anti-transthyretin DsiRNAs, Unmodified Duplexes
(Asymmetrics)

| | | |
|---|---|---|
| TTR-419 Target: | 5'-GGGAUAUACAAAGUGGAAAUAGACA-3'<br>3'-UUCCCUAUAUGUUUCACCUUUAUCUGU-5'<br>5'-AAGGGATATACAAAGTGGAAATAGACA-3' | (SEQ ID NO: 1281)<br>(SEQ ID NO: 513)<br>(SEQ ID NO: 897) |
| TTR-420 Target: | 5'-GGAUAUACAAAGUGGAAAUAGACAC-3'<br>3'-UCCCUAUAUGUUUCACCUUUAUCUGUG-5'<br>5'-AGGGATATACAAAGTGGAAATAGACAC-3' | (SEQ ID NO: 1282)<br>(SEQ ID NO: 514)<br>(SEQ ID NO: 898) |
| TTR-421 Target: | 5'-GAUAUACAAAGUGGAAAUAGACACC-3'<br>3'-CCCUAUAUGUUUCACCUUUAUCUGUGG-5'<br>5'-GGGATATACAAAGTGGAAATAGACACC-3' | (SEQ ID NO: 1283)<br>(SEQ ID NO: 515)<br>(SEQ ID NO: 899) |
| TTR-422 Target: | 5'-AUAUACAAAGUGGAAAUAGACACCA-3'<br>3'-CCUAUAUGUUUCACCUUUAUCUGUGGU-5'<br>5'-GGATATACAAAGTGGAAATAGACACCA-3' | (SEQ ID NO: 1284)<br>(SEQ ID NO: 516)<br>(SEQ ID NO: 900) |
| TTR-423 Target: | 5'-UAUACAAAGUGGAAAUAGACACCAA-3'<br>3'-CUAUAUGUUUCACCUUUAUCUGUGGUU-5'<br>5'-GATATACAAAGTGGAAATAGACACCAA-3' | (SEQ ID NO: 1285)<br>(SEQ ID NO: 517)<br>(SEQ ID NO: 901) |
| TTR-424 Target: | 5'-AUACAAAGUGGAAAUAGACACCAAA-3'<br>3'-UAUAUGUUUCACCUUUAUCUGUGGUUU-5'<br>5'-ATATACAAAGTGGAAATAGACACCAAA-3' | (SEQ ID NO: 1286)<br>(SEQ ID NO: 518)<br>(SEQ ID NO: 902) |
| TTR-425 Target: | 5'-UACAAAGUGGAAAUAGACACCAAAU-3'<br>3'-AUAUGUUUCACCUUUAUCUGUGGUUUA-5'<br>5'-TATACAAAGTGGAAATAGACACCAAAT-3' | (SEQ ID NO: 1287)<br>(SEQ ID NO: 519)<br>(SEQ ID NO: 903) |
| TTR-426 Target: | 5'-ACAAAGUGGAAAUAGACACCAAAUC-3'<br>3'-UAUGUUUCACCUUUAUCUGUGGUUUAG-5'<br>5'-ATACAAAGTGGAAATAGACACCAAATC-3' | (SEQ ID NO: 1288)<br>(SEQ ID NO: 520)<br>(SEQ ID NO: 904) |
| TTR-427 Target: | 5'-CAAAGUGGAAAUAGACACCAAAUCU-3'<br>3'-AUGUUUCACCUUUAUCUGUGGUUUAGA-5'<br>5'-TACAAAGTGGAAATAGACACCAAATCT-3' | (SEQ ID NO: 1289)<br>(SEQ ID NO: 521)<br>(SEQ ID NO: 905) |
| TTR-428 Target: | 5'-AAAGUGGAAAUAGACACCAAAUCUU-3'<br>3'-UGUUUCACCUUUAUCUGUGGUUUAGAA-5'<br>5'-ACAAAGTGGAAATAGACACCAAATCTT-3' | (SEQ ID NO: 1290)<br>(SEQ ID NO: 522)<br>(SEQ ID NO: 906) |
| TTR-429 Target: | 5'-AAGUGGAAAUAGACACCAAAUCUUA-3'<br>3'-GUUUCACCUUUAUCUGUGGUUUAGAAU-5'<br>5'-CAAAGTGGAAATAGACACCAAATCTTA-3' | (SEQ ID NO: 1291)<br>(SEQ ID NO: 523)<br>(SEQ ID NO: 907) |
| TTR-430 Target: | 5'-AGUGGAAAUAGACACCAAAUCUUAC-3'<br>3'-UUUCACCUUUAUCUGUGGUUUAGAAUG-5'<br>5'-AAAGTGGAAATAGACACCAAATCTTAC-3' | (SEQ ID NO: 1292)<br>(SEQ ID NO: 524)<br>(SEQ ID NO: 908) |
| TTR-431 Target: | 5'-GUGGAAAUAGACACCAAAUCUUACU-3'<br>3'-UUCACCUUUAUCUGUGGUUUAGAAUGA-5'<br>5'-AAGTGGAAATAGACACCAAATCTTACT-3' | (SEQ ID NO: 1293)<br>(SEQ ID NO: 525)<br>(SEQ ID NO: 909) |
| TTR-432 Target: | 5'-UGGAAAUAGACACCAAAUCUUACUG-3'<br>3'-UCACCUUUAUCUGUGGUUUAGAAUGAC-5'<br>5'-AGTGGAAATAGACACCAAATCTTACTG-3' | (SEQ ID NO: 1294)<br>(SEQ ID NO: 526)<br>(SEQ ID NO: 910) |
| TTR-433 Target: | 5'-GGAAAUAGACACCAAAUCUUACUGG-3'<br>3'-CACCUUUAUCUGUGGUUUAGAAUGACC-5'<br>5'-GTGGAAATAGACACCAAATCTTACTGG-3' | (SEQ ID NO: 1295)<br>(SEQ ID NO: 527)<br>(SEQ ID NO: 911) |
| TTR-434 Target: | 5'-GAAAUAGACACCAAAUCUUACUGGA-3'<br>3'-ACCUUUAUCUGUGGUUUAGAAUGACCU-5'<br>5'-TGGAAATAGACACCAAATCTTACTGGA-3' | (SEQ ID NO: 1296)<br>(SEQ ID NO: 528)<br>(SEQ ID NO: 912) |
| TTR-435 Target: | 5'-AAAUAGACACCAAAUCUUACUGGAA-3'<br>3'-CCUUUAUCUGUGGUUUAGAAUGACCUU-5'<br>5'-GGAAATAGACACCAAATCTTACTGGAA-3' | (SEQ ID NO: 1297)<br>(SEQ ID NO: 529)<br>(SEQ ID NO: 913) |
| TTR-436 Target: | 5'-AAUAGACACCAAAUCUUACUGGAAG-3'<br>3'-CUUUAUCUGUGGUUUAGAAUGACCUUC-5'<br>5'-GAAATAGACACCAAATCTTACTGGAAG-3' | (SEQ ID NO: 1298)<br>(SEQ ID NO: 530)<br>(SEQ ID NO: 914) |
| TTR-437 Target: | 5'-AUAGACACCAAAUCUUACUGGAAGG-3'<br>3'-UUUAUCUGUGGUUUAGAAUGACCUUCC-5'<br>5'-AAATAGACACCAAATCTTACTGGAAGG-3' | (SEQ ID NO: 1299)<br>(SEQ ID NO: 531)<br>(SEQ ID NO: 915) |

TABLE 3-continued

Selected Human Anti-transthyretin DsiRNAs, Unmodified Duplexes
(Asymmetrics)

| | | |
|---|---|---|
| TTR-439 | 5'-AGACACCAAAUCUUACUGGAAGGCA-3'<br>3'-UAUCUGUGGUUUAGAAUGACCUUCCGU-5'<br>Target: 5'-ATAGACACCAAATCTTACTGGAAGGCA-3' | (SEQ ID NO: 1300)<br>(SEQ ID NO: 532)<br>(SEQ ID NO: 916) |
| TTR-440 | 5'-GACACCAAAUCUUACUGGAAGGCAC-3'<br>3'-AUCUGUGGUUUAGAAUGACCUUCCGUG-5'<br>Target: 5'-TAGACACCAAATCTTACTGGAAGGCAC-3' | (SEQ ID NO: 1301)<br>(SEQ ID NO: 533)<br>(SEQ ID NO: 917) |
| TTR-462 | 5'-CACUUGGCAUCUCCCCAUUCCAUGA-3'<br>3'-CCGUGAACCGUAGAGGGGUAAGGUACU-5'<br>Target: 5'-GGCACTTGGCATCTCCCCATTCCATGA-3' | (SEQ ID NO: 1302)<br>(SEQ ID NO: 534)<br>(SEQ ID NO: 918) |
| TTR-463 | 5'-ACUUGGCAUCUCCCCAUUCCAUGAG-3'<br>3'-CGUGAACCGUAGAGGGGUAAGGUACUC-5'<br>Target: 5'-GCACTTGGCATCTCCCCATTCCATGAG-3' | (SEQ ID NO: 1303)<br>(SEQ ID NO: 535)<br>(SEQ ID NO: 919) |
| TTR-464 | 5'-CUUGGCAUCUCCCCAUUCCAUGAGC-3'<br>3'-GUGAACCGUAGAGGGGUAAGGUACUCG-5'<br>Target: 5'-CACTTGGCATCTCCCCATTCCATGAGC-3' | (SEQ ID NO: 1304)<br>(SEQ ID NO: 536)<br>(SEQ ID NO: 920) |
| TTR-465 | 5'-UUGGCAUCUCCCCAUUCCAUGAGCA-3'<br>3'-UGAACCGUAGAGGGGUAAGGUACUCGU-5'<br>Target: 5'-ACTTGGCATCTCCCCATTCCATGAGCA-3' | (SEQ ID NO: 1305)<br>(SEQ ID NO: 537)<br>(SEQ ID NO: 921) |
| TTR-466 | 5'-UGGCAUCUCCCCAUUCCAUGAGCAU-3'<br>3'-GAACCGUAGAGGGGUAAGGUACUCGUA-5'<br>Target: 5'-CTTGGCATCTCCCCATTCCATGAGCAT-3' | (SEQ ID NO: 1306)<br>(SEQ ID NO: 538)<br>(SEQ ID NO: 922) |
| TTR-467 | 5'-GGCAUCUCCCCAUUCCAUGAGCAUG-3'<br>3'-AACCGUAGAGGGGUAAGGUACUCGUAC-5'<br>Target: 5'-TTGGCATCTCCCCATTCCATGAGCATG-3' | (SEQ ID NO: 1307)<br>(SEQ ID NO: 539)<br>(SEQ ID NO: 923) |
| TTR-468 | 5'-GCAUCUCCCCAUUCCAUGAGCAUGC-3'<br>3'-ACCGUAGAGGGGUAAGGUACUCGUACG-5'<br>Target: 5'-TGGCATCTCCCCATTCCATGAGCATGC-3' | (SEQ ID NO: 1308)<br>(SEQ ID NO: 540)<br>(SEQ ID NO: 924) |
| TTR-469 | 5'-CAUCUCCCCAUUCCAUGAGCAUGCA-3'<br>3'-CCGUAGAGGGGUAAGGUACUCGUACGU-5'<br>Target: 5'-GGCATCTCCCCATTCCATGAGCATGCA-3' | (SEQ ID NO: 1309)<br>(SEQ ID NO: 541)<br>(SEQ ID NO: 925) |
| TTR-470 | 5'-AUCUCCCCAUUCCAUGAGCAUGCAG-3'<br>3'-CGUAGAGGGGUAAGGUACUCGUACGUC-5'<br>Target: 5'-GCATCTCCCCATTCCATGAGCATGCAG-3' | (SEQ ID NO: 1310)<br>(SEQ ID NO: 542)<br>(SEQ ID NO: 926) |
| TTR-471 | 5'-UCUCCCCAUUCCAUGAGCAUGCAGA-3'<br>3'-GUAGAGGGGUAAGGUACUCGUACGUCU-5'<br>Target: 5'-CATCTCCCCATTCCATGAGCATGCAGA-3' | (SEQ ID NO: 1311)<br>(SEQ ID NO: 543)<br>(SEQ ID NO: 927) |
| TTR-472 | 5'-CUCCCCAUUCCAUGAGCAUGCAGAG-3'<br>3'-UAGAGGGGUAAGGUACUCGUACGUCUC-5'<br>Target: 5'-ATCTCCCCATTCCATGAGCATGCAGAG-3' | (SEQ ID NO: 1312)<br>(SEQ ID NO: 544)<br>(SEQ ID NO: 928) |
| TTR-473 | 5'-UCCCCAUUCCAUGAGCAUGCAGAGG-3'<br>3'-AGAGGGGUAAGGUACUCGUACGUCUCC-5'<br>Target: 5'-TCTCCCCATTCCATGAGCATGCAGAGG-3' | (SEQ ID NO: 1313)<br>(SEQ ID NO: 545)<br>(SEQ ID NO: 929) |
| TTR-474 | 5'-CCCCAUUCCAUGAGCAUGCAGAGGU-3'<br>3'-GAGGGGUAAGGUACUCGUACGUCUCCA-5'<br>Target: 5'-CTCCCCATTCCATGAGCATGCAGAGGT-3' | (SEQ ID NO: 1314)<br>(SEQ ID NO: 546)<br>(SEQ ID NO: 930) |
| TTR-482 | 5'-CAUGAGCAUGCAGAGGUGGUAUUCA-3'<br>3'-AGGUACUCGUACGUCUCCACCAUAAGU-5'<br>Target: 5'-TCCATGAGCATGCAGAGGTGGTATTCA-3' | (SEQ ID NO: 1315)<br>(SEQ ID NO: 547)<br>(SEQ ID NO: 931) |
| TTR-483 | 5'-AUGAGCAUGCAGAGGUGGUAUUCAC-3'<br>3'-GGUACUCGUACGUCUCCACCAUAAGUG-5'<br>Target: 5'-CCATGAGCATGCAGAGGTGGTATTCAC-3' | (SEQ ID NO: 1316)<br>(SEQ ID NO: 548)<br>(SEQ ID NO: 932) |
| TTR-484 | 5'-UGAGCAUGCAGAGGUGGUAUUCACA-3'<br>3'-GUACUCGUACGUCUCCACCAUAAGUGU-5'<br>Target: 5'-CATGAGCATGCAGAGGTGGTATTCACA-3' | (SEQ ID NO: 1317)<br>(SEQ ID NO: 549)<br>(SEQ ID NO: 933) |
| TTR-485 | 5'-GAGCAUGCAGAGGUGGUAUUCACAG-3'<br>3'-UACUCGUACGUCUCCACCAUAAGUGUC-5'<br>Target: 5'-ATGAGCATGCAGAGGTGGTATTCACAG-3' | (SEQ ID NO: 1318)<br>(SEQ ID NO: 550)<br>(SEQ ID NO: 934) |

TABLE 3-continued

Selected Human Anti-transthyretin DsiRNAs, Unmodified Duplexes (Asymmetrics)

|  |  |  |
|---|---|---|
| TTR-489 | 5'-AUGCAGAGGUGGUAUUCACAGCCAA-3'<br>3'-CGUACGUCUCCACCAUAAGUGUCGGUU-5'<br>Target: 5'-GCATGCAGAGGTGGTATTCACAGCCAA-3' | (SEQ ID NO: 1319)<br>(SEQ ID NO: 551)<br>(SEQ ID NO: 935) |
| TTR-493 | 5'-AGAGGUGGUAUUCACAGCCAACGAC-3'<br>3'-CGUCUCCACCAUAAGUGUCGGUUGCUG-5'<br>Target: 5'-GCAGAGGTGGTATTCACAGCCAACGAC-3' | (SEQ ID NO: 1320)<br>(SEQ ID NO: 552)<br>(SEQ ID NO: 936) |
| TTR-494 | 5'-GAGGUGGUAUUCACAGCCAACGACU-3'<br>3'-GUCUCCACCAUAAGUGUCGGUUGCUGA-5'<br>Target: 5'-CAGAGGTGGTATTCACAGCCAACGACT-3' | (SEQ ID NO: 1321)<br>(SEQ ID NO: 553)<br>(SEQ ID NO: 937) |
| TTR-581 | 5'-GUCGUCACCAAUCCCAAGGAAUGAG-3'<br>3'-GACAGCAGUGGUUAGGGUUCCUUACUC-5'<br>Target: 5'-CTGTCGTCACCAATCCCAAGGAATGAG-3' | (SEQ ID NO: 1322)<br>(SEQ ID NO: 554)<br>(SEQ ID NO: 938) |
| TTR-631 | 5'-GGACGAGGGAUGGGAUUUCAUGUAA-3'<br>3'-UUCCUGCUCCCUACCCUAAAGUACAUU-5'<br>Target: 5'-AAGGACGAGGGATGGGATTTCATGTAA-3' | (SEQ ID NO: 1323)<br>(SEQ ID NO: 555)<br>(SEQ ID NO: 939) |
| TTR-632 | 5'-GACGAGGGAUGGGAUUUCAUGUAAC-3'<br>3'-UCCUGCUCCCUACCCUAAAGUACAUUG-5'<br>Target: 5'-AGGACGAGGGATGGGATTTCATGTAAC-3' | (SEQ ID NO: 1324)<br>(SEQ ID NO: 556)<br>(SEQ ID NO: 940) |
| TTR-635 | 5'-GAGGGAUGGGAUUUCAUGUAACCAA-3'<br>3'-UGCUCCCUACCCUAAAGUACAUUGGUU-5'<br>Target: 5'-ACGAGGGATGGGATTTCATGTAACCAA-3' | (SEQ ID NO: 1325)<br>(SEQ ID NO: 557)<br>(SEQ ID NO: 941) |
| TTR-636 | 5'-AGGGAUGGGAUUUCAUGUAACCAAG-3'<br>3'-GCUCCCUACCCUAAAGUACAUUGGUUC-5'<br>Target: 5'-CGAGGGATGGGATTTCATGTAACCAAG-3' | (SEQ ID NO: 1326)<br>(SEQ ID NO: 558)<br>(SEQ ID NO: 942) |
| TTR-637 | 5'-GGGAUGGGAUUUCAUGUAACCAAGA-3'<br>3'-CUCCCUACCCUAAAGUACAUUGGUUCU-5'<br>Target: 5'-GAGGGATGGGATTTCATGTAACCAAGA-3' | (SEQ ID NO: 1327)<br>(SEQ ID NO: 559)<br>(SEQ ID NO: 943) |
| TTR-639 | 5'-GAUGGGAUUUCAUGUAACCAAGAGU-3'<br>3'-CCCUACCCUAAAGUACAUUGGUUCUCA-5'<br>Target: 5'-GGGATGGGATTTCATGTAACCAAGAGT-3' | (SEQ ID NO: 1328)<br>(SEQ ID NO: 560)<br>(SEQ ID NO: 944) |
| TTR-640 | 5'-AUGGGAUUUCAUGUAACCAAGAGUA-3'<br>3'-CCUACCCUAAAGUACAUUGGUUCUCAU-5'<br>Target: 5'-GGATGGGATTTCATGTAACCAAGAGTA-3' | (SEQ ID NO: 1329)<br>(SEQ ID NO: 561)<br>(SEQ ID NO: 945) |
| TTR-641 | 5'-UGGGAUUUCAUGUAACCAAGAGUAU-3'<br>3'-CUACCCUAAAGUACAUUGGUUCUCAUA-5'<br>Target: 5'-GATGGGATTTCATGTAACCAAGAGTAT-3' | (SEQ ID NO: 1330)<br>(SEQ ID NO: 562)<br>(SEQ ID NO: 946) |
| TTR-642 | 5'-GGGAUUUCAUGUAACCAAGAGUAUU-3'<br>3'-UACCCUAAAGUACAUUGGUUCUCAUAA-5'<br>Target: 5'-ATGGGATTTCATGTAACCAAGAGTATT-3' | (SEQ ID NO: 1331)<br>(SEQ ID NO: 563)<br>(SEQ ID NO: 947) |
| TTR-643 | 5'-GGAUUUCAUGUAACCAAGAGUAUUC-3'<br>3'-ACCCUAAAGUACAUUGGUUCUCAUAAG-5'<br>Target: 5'-TGGGATTTCATGTAACCAAGAGTATTC-3' | (SEQ ID NO: 1332)<br>(SEQ ID NO: 564)<br>(SEQ ID NO: 948) |
| TTR-644 | 5'-GAUUUCAUGUAACCAAGAGUAUUCC-3'<br>3'-CCCUAAAGUACAUUGGUUCUCAUAAGG-5'<br>Target: 5'-GGGATTTCATGTAACCAAGAGTATTCC-3' | (SEQ ID NO: 1333)<br>(SEQ ID NO: 565)<br>(SEQ ID NO: 949) |
| TTR-645 | 5'-AUUUCAUGUAACCAAGAGUAUUCCA-3'<br>3'-CCUAAAGUACAUUGGUUCUCAUAAGGU-5'<br>Target: 5'-GGATTTCATGTAACCAAGAGTATTCCA-3' | (SEQ ID NO: 1334)<br>(SEQ ID NO: 566)<br>(SEQ ID NO: 950) |
| TTR-646 | 5'-UUUCAUGUAACCAAGAGUAUUCCAU-3'<br>3'-CUAAAGUACAUUGGUUCUCAUAAGGUA-5'<br>Target: 5'-GATTTCATGTAACCAAGAGTATTCCAT-3' | (SEQ ID NO: 1335)<br>(SEQ ID NO: 567)<br>(SEQ ID NO: 951) |
| TTR-647 | 5'-UUCAUGUAACCAAGAGUAUUCCAUU-3'<br>3'-UAAAGUACAUUGGUUCUCAUAAGGUAA-5'<br>Target: 5'-ATTTCATGTAACCAAGAGTATTCCATT-3' | (SEQ ID NO: 1336)<br>(SEQ ID NO: 568)<br>(SEQ ID NO: 952) |
| TTR-648 | 5'-UCAUGUAACCAAGAGUAUUCCAUUU-3'<br>3'-AAAGUACAUUGGUUCUCAUAAGGUAAA-5'<br>Target: 5'-TTTCATGTAACCAAGAGTATTCCATTT-3' | (SEQ ID NO: 1337)<br>(SEQ ID NO: 569)<br>(SEQ ID NO: 953) |

TABLE 3-continued

Selected Human Anti-transthyretin DsiRNAs, Unmodified Duplexes
(Asymmetrics)

| | | |
|---|---|---|
| TTR-649 Target: | 5'-CAUGUAACCAAGAGUAUUCCAUUUU-3'<br>3'-AAGUACAUUGGUUCUCAUAAGGUAAAA-5'<br>5'-TTCATGTAACCAAGAGTATTCCATTTT-3' | (SEQ ID NO: 1338)<br>(SEQ ID NO: 570)<br>(SEQ ID NO: 954) |
| TTR-650 Target: | 5'-AUGUAACCAAGAGUAUUCCAUUUUU-3'<br>3'-AGUACAUUGGUUCUCAUAAGGUAAAAA-5'<br>5'-TCATGTAACCAAGAGTATTCCATTTTT-3' | (SEQ ID NO: 1339)<br>(SEQ ID NO: 571)<br>(SEQ ID NO: 955) |
| TTR-651 Target: | 5'-UGUAACCAAGAGUAUUCCAUUUUUA-3'<br>3'-GUACAUUGGUUCUCAUAAGGUAAAAAU-5'<br>5'-CATGTAACCAAGAGTATTCCATTTTTA-3' | (SEQ ID NO: 1340)<br>(SEQ ID NO: 572)<br>(SEQ ID NO: 956) |
| TTR-652 Target: | 5'-GUAACCAAGAGUAUUCCAUUUUUAC-3'<br>3'-UACAUUGGUUCUCAUAAGGUAAAAAUG-5'<br>5'-ATGTAACCAAGAGTATTCCATTTTTAC-3' | (SEQ ID NO: 1341)<br>(SEQ ID NO: 573)<br>(SEQ ID NO: 957) |
| TTR-653 Target: | 5'-UAACCAAGAGUAUUCCAUUUUUACU-3'<br>3'-ACAUUGGUUCUCAUAAGGUAAAAAUGA-5'<br>5'-TGTAACCAAGAGTATTCCATTTTTACT-3' | (SEQ ID NO: 1342)<br>(SEQ ID NO: 574)<br>(SEQ ID NO: 958) |
| TTR-654 Target: | 5'-AACCAAGAGUAUUCCAUUUUUACUA-3'<br>3'-CAUUGGUUCUCAUAAGGUAAAAAUGAU-5'<br>5'-GTAACCAAGAGTATTCCATTTTTACTA-3' | (SEQ ID NO: 1343)<br>(SEQ ID NO: 575)<br>(SEQ ID NO: 959) |
| TTR-655 Target: | 5'-ACCAAGAGUAUUCCAUUUUUACUAA-3'<br>3'-AUUGGUUCUCAUAAGGUAAAAAUGAUU-5'<br>5'-TAACCAAGAGTATTCCATTTTTACTAA-3' | (SEQ ID NO: 1344)<br>(SEQ ID NO: 576)<br>(SEQ ID NO: 960) |
| TTR-656 Target: | 5'-CCAAGAGUAUUCCAUUUUUACUAAA-3'<br>3'-UUGGUUCUCAUAAGGUAAAAAUGAUUU-5'<br>5'-AACCAAGAGTATTCCATTTTTACTAAA-3' | (SEQ ID NO: 1345)<br>(SEQ ID NO: 577)<br>(SEQ ID NO: 961) |
| TTR-657 Target: | 5'-CAAGAGUAUUCCAUUUUUACUAAAG-3'<br>3'-UGGUUCUCAUAAGGUAAAAAUGAUUUC-5'<br>5'-ACCAAGAGTATTCCATTTTTACTAAAG-3' | (SEQ ID NO: 1346)<br>(SEQ ID NO: 578)<br>(SEQ ID NO: 962) |
| TTR-658 Target: | 5'-AAGAGUAUUCCAUUUUUACUAAAGC-3'<br>3'-GGUUCUCAUAAGGUAAAAAUGAUUUCG-5'<br>5'-CCAAGAGTATTCCATTTTTACTAAAGC-3' | (SEQ ID NO: 1347)<br>(SEQ ID NO: 579)<br>(SEQ ID NO: 963) |
| TTR-659 Target: | 5'-AGAGUAUUCCAUUUUUACUAAAGCA-3'<br>3'-GUUCUCAUAAGGUAAAAAUGAUUUCGU-5'<br>5'-CAAGAGTATTCCATTTTTACTAAAGCA-3' | (SEQ ID NO: 1348)<br>(SEQ ID NO: 580)<br>(SEQ ID NO: 964) |
| TTR-660 Target: | 5'-GAGUAUUCCAUUUUUACUAAAGCAG-3'<br>3'-UUCUCAUAAGGUAAAAAUGAUUUCGUC-5'<br>5'-AAGAGTATTCCATTTTTACTAAAGCAG-3' | (SEQ ID NO: 1349)<br>(SEQ ID NO: 581)<br>(SEQ ID NO: 965) |
| TTR-661 Target: | 5'-AGUAUUCCAUUUUUACUAAAGCAGU-3'<br>3'-UCUCAUAAGGUAAAAAUGAUUUCGUCA-5'<br>5'-AGAGTATTCCATTTTTACTAAAGCAGT-3' | (SEQ ID NO: 1350)<br>(SEQ ID NO: 582)<br>(SEQ ID NO: 966) |
| TTR-662 Target: | 5'-GUAUUCCAUUUUUACUAAAGCAGUG-3'<br>3'-CUCAUAAGGUAAAAAUGAUUUCGUCAC-5'<br>5'-GAGTATTCCATTTTTACTAAAGCAGTG-3' | (SEQ ID NO: 1351)<br>(SEQ ID NO: 583)<br>(SEQ ID NO: 967) |
| TTR-663 Target: | 5'-UAUUCCAUUUUUACUAAAGCAGUGU-3'<br>3'-UCAUAAGGUAAAAAUGAUUUCGUCACA-5'<br>5'-AGTATTCCATTTTTACTAAAGCAGTGT-3' | (SEQ ID NO: 1352)<br>(SEQ ID NO: 584)<br>(SEQ ID NO: 968) |
| TTR-664 Target: | 5'-AUUCCAUUUUUACUAAAGCAGUGUU-3'<br>3'-CAUAAGGUAAAAAUGAUUUCGUCACAA-5'<br>5'-GTATTCCATTTTTACTAAAGCAGTGTT-3' | (SEQ ID NO: 1353)<br>(SEQ ID NO: 585)<br>(SEQ ID NO: 969) |
| TTR-665 Target: | 5'-UUCCAUUUUUACUAAAGCAGUGUUU-3'<br>3'-AUAAGGUAAAAAUGAUUUCGUCACAAA-5'<br>5'-TATTCCATTTTTACTAAAGCAGTGTTT-3' | (SEQ ID NO: 1354)<br>(SEQ ID NO: 586)<br>(SEQ ID NO: 970) |
| TTR-666 Target: | 5'-UCCAUUUUUACUAAAGCAGUGUUUU-3'<br>3'-UAAGGUAAAAAUGAUUUCGUCACAAAA-5'<br>5'-ATTCCATTTTTACTAAAGCAGTGTTTT-3' | (SEQ ID NO: 1355)<br>(SEQ ID NO: 587)<br>(SEQ ID NO: 971) |
| TTR-667 Target: | 5'-CCAUUUUUACUAAAGCAGUGUUUUC-3'<br>3'-AAGGUAAAAAUGAUUUCGUCACAAAAG-5'<br>5'-TTCCATTTTTACTAAAGCAGTGTTTTC-3' | (SEQ ID NO: 1356)<br>(SEQ ID NO: 588)<br>(SEQ ID NO: 972) |

TABLE 3-continued

Selected Human Anti-transthyretin DsiRNAs, Unmodified Duplexes
(Asymmetrics)

|  |  |  |
|---|---|---|
|  | 5'-CAUUUUUACUAAAGCAGUGUUUUCA-3' | (SEQ ID NO: 1357) |
|  | 3'-AGGUAAAAAUGAUUUCGUCACAAAAGU-5' | (SEQ ID NO: 589) |
| TTR-668 Target: | 5'-TCCATTTTTACTAAAGCAGTGTTTTCA-3' | (SEQ ID NO: 973) |
|  | 5'-AUUUUUACUAAAGCAGUGUUUUCAC-3' | (SEQ ID NO: 1358) |
|  | 3'-GGUAAAAAUGAUUUCGUCACAAAAGUG-5' | (SEQ ID NO: 590) |
| TTR-669 Target: | 5'-CCATTTTTACTAAAGCAGTGTTTTCAC-3' | (SEQ ID NO: 974) |
|  | 5'-UUUUUACUAAAGCAGUGUUUUCACC-3' | (SEQ ID NO: 1359) |
|  | 3'-GUAAAAAUGAUUUCGUCACAAAAGUGG-5' | (SEQ ID NO: 591) |
| TTR-670 Target: | 5'-CATTTTTACTAAAGCAGTGTTTTCACC-3' | (SEQ ID NO: 975) |
|  | 5'-UUUUACUAAAGCAGUGUUUUCACCU-3' | (SEQ ID NO: 1360) |
|  | 3'-UAAAAAUGAUUUCGUCACAAAAGUGGA-5' | (SEQ ID NO: 592) |
| TTR-671 Target: | 5'-ATTTTTACTAAAGCAGTGTTTTCACCT-3' | (SEQ ID NO: 976) |
|  | 5'-UUUACUAAAGCAGUGUUUUCACCUC-3' | (SEQ ID NO: 1361) |
|  | 3'-AAAAAUGAUUUCGUCACAAAAGUGGAG-5' | (SEQ ID NO: 593) |
| TTR-672 Target: | 5'-TTTTTACTAAAGCAGTGTTTTCACCTC-3' | (SEQ ID NO: 977) |
|  | 5'-UUACUAAAGCAGUGUUUUCACCUCA-3' | (SEQ ID NO: 1362) |
|  | 3'-AAAAUGAUUUCGUCACAAAAGUGGAGU-5' | (SEQ ID NO: 594) |
| TTR-673 Target: | 5'-TTTTACTAAAGCAGTGTTTTCACCTCA-3' | (SEQ ID NO: 978) |
|  | 5'-UACUAAAGCAGUGUUUUCACCUCAU-3' | (SEQ ID NO: 1363) |
|  | 3'-AAAUGAUUUCGUCACAAAAGUGGAGUA-5' | (SEQ ID NO: 595) |
| TTR-674 Target: | 5'-TTTACTAAAGCAGTGTTTTCACCTCAT-3' | (SEQ ID NO: 979) |
|  | 5'-ACUAAAGCAGUGUUUUCACCUCAUA-3' | (SEQ ID NO: 1364) |
|  | 3'-AAUGAUUUCGUCACAAAAGUGGAGUAU-5' | (SEQ ID NO: 596) |
| TTR-675 Target: | 5'-TTACTAAAGCAGTGTTTTCACCTCATA-3' | (SEQ ID NO: 980) |
|  | 5'-CUAAAGCAGUGUUUUCACCUCAUAU-3' | (SEQ ID NO: 1365) |
|  | 3'-AUGAUUUCGUCACAAAAGUGGAGUAUA-5' | (SEQ ID NO: 597) |
| TTR-676 Target: | 5'-TACTAAAGCAGTGTTTTCACCTCATAT-3' | (SEQ ID NO: 981) |
|  | 5'-UAAAGCAGUGUUUUCACCUCAUAUG-3' | (SEQ ID NO: 1366) |
|  | 3'-UGAUUUCGUCACAAAAGUGGAGUAUAC-5' | (SEQ ID NO: 598) |
| TTR-677 Target: | 5'-ACTAAAGCAGTGTTTTCACCTCATATG-3' | (SEQ ID NO: 982) |
|  | 5'-AAAGCAGUGUUUUCACCUCAUAUGC-3' | (SEQ ID NO: 1367) |
|  | 3'-GAUUUCGUCACAAAAGUGGAGUAUACG-5' | (SEQ ID NO: 599) |
| TTR-678 Target: | 5'-CTAAAGCAGTGTTTTCACCTCATATGC-3' | (SEQ ID NO: 983) |
|  | 5'-AAGCAGUGUUUUCACCUCAUAUGCU-3' | (SEQ ID NO: 1368) |
|  | 3'-AUUUCGUCACAAAAGUGGAGUAUACGA-5' | (SEQ ID NO: 600) |
| TTR-679 Target: | 5'-TAAAGCAGTGTTTTCACCTCATATGCT-3' | (SEQ ID NO: 984) |
|  | 5'-AGCAGUGUUUUCACCUCAUAUGCUA-3' | (SEQ ID NO: 1369) |
|  | 3'-UUUCGUCACAAAAGUGGAGUAUACGAU-5' | (SEQ ID NO: 601) |
| TTR-680 Target: | 5'-AAAGCAGTGTTTTCACCTCATATGCTA-3' | (SEQ ID NO: 985) |
|  | 5'-GCAGUGUUUUCACCUCAUAUGCUAU-3' | (SEQ ID NO: 1370) |
|  | 3'-UUCGUCACAAAAGUGGAGUAUACGAUA-5' | (SEQ ID NO: 602) |
| TTR-681 Target: | 5'-AAGCAGTGTTTTCACCTCATATGCTAT-3' | (SEQ ID NO: 986) |
|  | 5'-CAGUGUUUUCACCUCAUAUGCUAUG-3' | (SEQ ID NO: 1371) |
|  | 3'-UCGUCACAAAAGUGGAGUAUACGAUAC-5' | (SEQ ID NO: 603) |
| TTR-682 Target: | 5'-AGCAGTGTTTTCACCTCATATGCTATG-3' | (SEQ ID NO: 987) |
|  | 5'-AGUGUUUUCACCUCAUAUGCUAUGU-3' | (SEQ ID NO: 1372) |
|  | 3'-CGUCACAAAAGUGGAGUAUACGAUACA-5' | (SEQ ID NO: 604) |
| TTR-683 Target: | 5'-GCAGTGTTTTCACCTCATATGCTATGT-3' | (SEQ ID NO: 988) |
|  | 5'-GUGUUUUCACCUCAUAUGCUAUGUU-3' | (SEQ ID NO: 1373) |
|  | 3'-GUCACAAAAGUGGAGUAUACGAUACAA-5' | (SEQ ID NO: 605) |
| TTR-684 Target: | 5'-CAGTGTTTTCACCTCATATGCTATGTT-3' | (SEQ ID NO: 989) |
|  | 5'-UGUUUUCACCUCAUAUGCUAUGUUA-3' | (SEQ ID NO: 1374) |
|  | 3'-UCACAAAAGUGGAGUAUACGAUACAAU-5' | (SEQ ID NO: 606) |
| TTR-685 Target: | 5'-AGTGTTTTCACCTCATATGCTATGTTA-3' | (SEQ ID NO: 990) |
|  | 5'-GUUUUCACCUCAUAUGCUAUGUUAG-3' | (SEQ ID NO: 1375) |
|  | 3'-CACAAAAGUGGAGUAUACGAUACAAUC-5' | (SEQ ID NO: 607) |
| TTR-686 Target: | 5'-GTGTTTTCACCTCATATGCTATGTTAG-3' | (SEQ ID NO: 991) |

TABLE 3-continued

Selected Human Anti-transthyretin DsiRNAs, Unmodified Duplexes (Asymmetrics)

|  |  |  |
|---|---|---|
| TTR-687 | 5'-UUUUCACCUCAUAUGCUAUGUUAGA-3'<br>3'-ACAAAAGUGGAGUAUACGAUACAAUCU-5'<br>Target: 5'-TGTTTTCACCTCATATGCTATGTTAGA-3' | (SEQ ID NO: 1376)<br>(SEQ ID NO: 608)<br>(SEQ ID NO: 992) |
| TTR-688 | 5'-UUUCACCUCAUAUGCUAUGUUAGAA-3'<br>3'-CAAAAGUGGAGUAUACGAUACAAUCUU-5'<br>Target: 5'-GTTTTCACCTCATATGCTATGTTAGAA-3' | (SEQ ID NO: 1377)<br>(SEQ ID NO: 609)<br>(SEQ ID NO: 993) |
| TTR-689 | 5'-UUCACCUCAUAUGCUAUGUUAGAAG-3'<br>3'-AAAAGUGGAGUAUACGAUACAAUCUUC-5'<br>Target: 5'-TTTTCACCTCATATGCTATGTTAGAAG-3' | (SEQ ID NO: 1378)<br>(SEQ ID NO: 610)<br>(SEQ ID NO: 994) |
| TTR-690 | 5'-UCACCUCAUAUGCUAUGUUAGAAGU-3'<br>3'-AAAGUGGAGUAUACGAUACAAUCUUCA-5'<br>Target: 5'-TTTCACCTCATATGCTATGTTAGAAGT-3' | (SEQ ID NO: 1379)<br>(SEQ ID NO: 611)<br>(SEQ ID NO: 995) |
| TTR-691 | 5'-CACCUCAUAUGCUAUGUUAGAAGUC-3'<br>3'-AAGUGGAGUAUACGAUACAAUCUUCAG-5'<br>Target: 5'-TTCACCTCATATGCTATGTTAGAAGTC-3' | (SEQ ID NO: 1380)<br>(SEQ ID NO: 612)<br>(SEQ ID NO: 996) |
| TTR-692 | 5'-ACCUCAUAUGCUAUGUUAGAAGUCC-3'<br>3'-AGUGGAGUAUACGAUACAAUCUUCAGG-5'<br>Target: 5'-TCACCTCATATGCTATGTTAGAAGTCC-3' | (SEQ ID NO: 1381)<br>(SEQ ID NO: 613)<br>(SEQ ID NO: 997) |
| TTR-693 | 5'-CCUCAUAUGCUAUGUUAGAAGUCCA-3'<br>3'-GUGGAGUAUACGAUACAAUCUUCAGGU-5'<br>Target: 5'-CACCTCATATGCTATGTTAGAAGTCCA-3' | (SEQ ID NO: 1382)<br>(SEQ ID NO: 614)<br>(SEQ ID NO: 998) |
| TTR-694 | 5'-CUCAUAUGCUAUGUUAGAAGUCCAG-3'<br>3'-UGGAGUAUACGAUACAAUCUUCAGGUC-5'<br>Target: 5'-ACCTCATATGCTATGTTAGAAGTCCAG-3' | (SEQ ID NO: 1383)<br>(SEQ ID NO: 615)<br>(SEQ ID NO: 999) |
| TTR-695 | 5'-UCAUAUGCUAUGUUAGAAGUCCAGG-3'<br>3'-GGAGUAUACGAUACAAUCUUCAGGUCC-5'<br>Target: 5'-CCTCATATGCTATGTTAGAAGTCCAGG-3' | (SEQ ID NO: 1384)<br>(SEQ ID NO: 616)<br>(SEQ ID NO: 1000) |
| TTR-696 | 5'-CAUAUGCUAUGUUAGAAGUCCAGGC-3'<br>3'-GAGUAUACGAUACAAUCUUCAGGUCCG-5'<br>Target: 5'-CTCATATGCTATGTTAGAAGTCCAGGC-3' | (SEQ ID NO: 1385)<br>(SEQ ID NO: 617)<br>(SEQ ID NO: 1001) |
| TTR-697 | 5'-AUAUGCUAUGUUAGAAGUCCAGGCA-3'<br>3'-AGUAUACGAUACAAUCUUCAGGUCCGU-5'<br>Target: 5'-TCATATGCTATGTTAGAAGTCCAGGCA-3' | (SEQ ID NO: 1386)<br>(SEQ ID NO: 618)<br>(SEQ ID NO: 1002) |
| TTR-698 | 5'-UAUGCUAUGUUAGAAGUCCAGGCAG-3'<br>3'-GUAUACGAUACAAUCUUCAGGUCCGUC-5'<br>Target: 5'-CATATGCTATGTTAGAAGTCCAGGCAG-3' | (SEQ ID NO: 1387)<br>(SEQ ID NO: 619)<br>(SEQ ID NO: 1003) |
| TTR-699 | 5'-AUGCUAUGUUAGAAGUCCAGGCAGA-3'<br>3'-UAUACGAUACAAUCUUCAGGUCCGUCU-5'<br>Target: 5'-ATATGCTATGTTAGAAGTCCAGGCAGA-3' | (SEQ ID NO: 1388)<br>(SEQ ID NO: 620)<br>(SEQ ID NO: 1004) |
| TTR-702 | 5'-CUAUGUUAGAAGUCCAGGCAGAGAC-3'<br>3'-ACGAUACAAUCUUCAGGUCCGUCUCUG-5'<br>Target: 5'-TGCTATGTTAGAAGTCCAGGCAGAGAC-3' | (SEQ ID NO: 1389)<br>(SEQ ID NO: 621)<br>(SEQ ID NO: 1005) |
| TTR-704 | 5'-AUGUUAGAAGUCCAGGCAGAGACAA-3'<br>3'-GAUACAAUCUUCAGGUCCGUCUCUGUU-5'<br>Target: 5'-CTATGTTAGAAGTCCAGGCAGAGACAA-3' | (SEQ ID NO: 1390)<br>(SEQ ID NO: 622)<br>(SEQ ID NO: 1006) |
| TTR-705 | 5'-UGUUAGAAGUCCAGGCAGAGACAAU-3'<br>3'-AUACAAUCUUCAGGUCCGUCUCUGUUA-5'<br>Target: 5'-TATGTTAGAAGTCCAGGCAGAGACAAT-3' | (SEQ ID NO: 1391)<br>(SEQ ID NO: 623)<br>(SEQ ID NO: 1007) |
| TTR-706 | 5'-GUUAGAAGUCCAGGCAGAGACAAUA-3'<br>3'-UACAAUCUUCAGGUCCGUCUCUGUUAU-5'<br>Target: 5'-ATGTTAGAAGTCCAGGCAGAGACAATA-3' | (SEQ ID NO: 1392)<br>(SEQ ID NO: 624)<br>(SEQ ID NO: 1008) |
| TTR-707 | 5'-UUAGAAGUCCAGGCAGAGACAAUAA-3'<br>3'-ACAAUCUUCAGGUCCGUCUCUGUUAUU-5'<br>Target: 5'-TGTTAGAAGTCCAGGCAGAGACAATAA-3' | (SEQ ID NO: 1393)<br>(SEQ ID NO: 625)<br>(SEQ ID NO: 1009) |
| TTR-708 | 5'-UAGAAGUCCAGGCAGAGACAAUAAA-3'<br>3'-CAAUCUUCAGGUCCGUCUCUGUUAUUU-5'<br>Target: 5'-GTTAGAAGTCCAGGCAGAGACAATAAA-3' | (SEQ ID NO: 1394)<br>(SEQ ID NO: 626)<br>(SEQ ID NO: 1010) |

TABLE 3-continued

Selected Human Anti-transthyretin DsiRNAs, Unmodified Duplexes (Asymmetrics)

| | | |
|---|---|---|
| TTR-709 Target: | 5'-AGAAGUCCAGGCAGAGACAAUAAAA-3'<br>3'-AAUCUUCAGGUCCGUCUCUGUUAUUUU-5'<br>5'-TTAGAAGTCCAGGCAGAGACAATAAAA-3' | (SEQ ID NO: 1395)<br>(SEQ ID NO: 627)<br>(SEQ ID NO: 1011) |
| TTR-710 Target: | 5'-GAAGUCCAGGCAGAGACAAUAAAAC-3'<br>3'-AUCUUCAGGUCCGUCUCUGUUAUUUUG-5'<br>5'-TAGAAGTCCAGGCAGAGACAATAAAAC-3' | (SEQ ID NO: 1396)<br>(SEQ ID NO: 628)<br>(SEQ ID NO: 1012) |
| TTR-711 Target: | 5'-AAGUCCAGGCAGAGACAAUAAAACA-3'<br>3'-UCUUCAGGUCCGUCUCUGUUAUUUUGU-5'<br>5'-AGAAGTCCAGGCAGAGACAATAAAACA-3' | (SEQ ID NO: 1397)<br>(SEQ ID NO: 629)<br>(SEQ ID NO: 1013) |
| TTR-712 Target: | 5'-AGUCCAGGCAGAGACAAUAAAACAU-3'<br>3'-CUUCAGGUCCGUCUCUGUUAUUUUGUA-5'<br>5'-GAAGTCCAGGCAGAGACAATAAAACAT-3' | (SEQ ID NO: 1398)<br>(SEQ ID NO: 630)<br>(SEQ ID NO: 1014) |
| TTR-713 Target: | 5'-GUCCAGGCAGAGACAAUAAAACAUU-3'<br>3'-UUCAGGUCCGUCUCUGUUAUUUUGUAA-5'<br>5'-AAGTCCAGGCAGAGACAATAAAACATT-3' | (SEQ ID NO: 1399)<br>(SEQ ID NO: 631)<br>(SEQ ID NO: 1015) |
| TTR-714 Target: | 5'-UCCAGGCAGAGACAAUAAAACAUUC-3'<br>3'-UCAGGUCCGUCUCUGUUAUUUUGUAAG-5'<br>5'-AGTCCAGGCAGAGACAATAAAACATTC-3' | (SEQ ID NO: 1400)<br>(SEQ ID NO: 632)<br>(SEQ ID NO: 1016) |
| TTR-716 Target: | 5'-CAGGCAGAGACAAUAAAACAUUCCU-3'<br>3'-AGGUCCGUCUCUGUUAUUUUGUAAGGA-5'<br>5'-TCCAGGCAGAGACAATAAAACATTCCT-3' | (SEQ ID NO: 1401)<br>(SEQ ID NO: 633)<br>(SEQ ID NO: 1017) |
| TTR-717 Target: | 5'-AGGCAGAGACAAUAAAACAUUCCUG-3'<br>3'-GGUCCGUCUCUGUUAUUUUGUAAGGAC-5'<br>5'-CCAGGCAGAGACAATAAAACATTCCTG-3' | (SEQ ID NO: 1402)<br>(SEQ ID NO: 634)<br>(SEQ ID NO: 1018) |
| TTR-718 Target: | 5'-GGCAGAGACAAUAAAACAUUCCUGU-3'<br>3'-GUCCGUCUCUGUUAUUUUGUAAGGACA-5'<br>5'-CAGGCAGAGACAATAAAACATTCCTGT-3' | (SEQ ID NO: 1403)<br>(SEQ ID NO: 635)<br>(SEQ ID NO: 1019) |
| TTR-719 Target: | 5'-GCAGAGACAAUAAAACAUUCCUGUG-3'<br>3'-UCCGUCUCUGUUAUUUUGUAAGGACAC-5'<br>5'-AGGCAGAGACAATAAAACATTCCTGTG-3' | (SEQ ID NO: 1404)<br>(SEQ ID NO: 636)<br>(SEQ ID NO: 1020) |
| TTR-720 Target: | 5'-CAGAGACAAUAAAACAUUCCUGUGA-3'<br>3'-CCGUCUCUGUUAUUUUGUAAGGACACU-5'<br>5'-GGCAGAGACAATAAAACATTCCTGTGA-3' | (SEQ ID NO: 1405)<br>(SEQ ID NO: 637)<br>(SEQ ID NO: 1021) |
| TTR-721 Target: | 5'-AGAGACAAUAAAACAUUCCUGUGAA-3'<br>3'-CGUCUCUGUUAUUUUGUAAGGACACUU-5'<br>5'-GCAGAGACAATAAAACATTCCTGTGAA-3' | (SEQ ID NO: 1406)<br>(SEQ ID NO: 638)<br>(SEQ ID NO: 1022) |
| TTR-722 Target: | 5'-GAGACAAUAAAACAUUCCUGUGAAA-3'<br>3'-GUCUCUGUUAUUUUGUAAGGACACUUU-5'<br>5'-CAGAGACAATAAAACATTCCTGTGAAA-3' | (SEQ ID NO: 1407)<br>(SEQ ID NO: 639)<br>(SEQ ID NO: 1023) |
| TTR-723 Target: | 5'-AGACAAUAAAACAUUCCUGUGAAAG-3'<br>3'-UCUCUGUUAUUUUGUAAGGACACUUUC-5'<br>5'-AGAGACAATAAAACATTCCTGTGAAAG-3' | (SEQ ID NO: 1408)<br>(SEQ ID NO: 640)<br>(SEQ ID NO: 1024) |
| TTR-724 Target: | 5'-GACAAUAAAACAUUCCUGUGAAAGG-3'<br>3'-CUCUGUUAUUUUGUAAGGACACUUUCC-5'<br>5'-GAGACAATAAAACATTCCTGTGAAAGG-3' | (SEQ ID NO: 1409)<br>(SEQ ID NO: 641)<br>(SEQ ID NO: 1025) |
| TTR-725 Target: | 5'-ACAAUAAAACAUUCCUGUGAAAGGC-3'<br>3'-UCUGUUAUUUUGUAAGGACACUUUCCG-5'<br>5'-AGACAATAAAACATTCCTGTGAAAGGC-3' | (SEQ ID NO: 1410)<br>(SEQ ID NO: 642)<br>(SEQ ID NO: 1026) |
| TTR-726 Target: | 5'-CAAUAAAACAUUCCUGUGAAAGGCA-3'<br>3'-CUGUUAUUUUGUAAGGACACUUUCCGU-5'<br>5'-GACAATAAAACATTCCTGTGAAAGGCA-3' | (SEQ ID NO: 1411)<br>(SEQ ID NO: 643)<br>(SEQ ID NO: 1027) |
| TTR-727 Target: | 5'-AAUAAAACAUUCCUGUGAAAGGCAC-3'<br>3'-UGUUAUUUUGUAAGGACACUUUCCGUG-5'<br>5'-ACAATAAAACATTCCTGTGAAAGGCAC-3' | (SEQ ID NO: 1412)<br>(SEQ ID NO: 644)<br>(SEQ ID NO: 1028) |
| TTR-728 Target: | 5'-AUAAAACAUUCCUGUGAAAGGCACU-3'<br>3'-GUUAUUUUGUAAGGACACUUUCCGUGA-5'<br>5'-CAATAAAACATTCCTGTGAAAGGCACT-3' | (SEQ ID NO: 1413)<br>(SEQ ID NO: 645)<br>(SEQ ID NO: 1029) |

TABLE 3-continued

Selected Human Anti-transthyretin DsiRNAs, Unmodified Duplexes (Asymmetrics)

| | | |
|---|---|---|
| | 5'-AAACAUUCCUGUGAAAGGCACUUUU-3' | (SEQ ID NO: 1414) |
| | 3'-AUUUUGUAAGGACACUUUCCGUGAAAA-5' | (SEQ ID NO: 646) |
| TTR-731 Target: | 5'-TAAAACATTCCTGTGAAAGGCACTTTT-3' | (SEQ ID NO: 1030) |
| | 5'-AACAUUCCUGUGAAAGGCACUUUUC-3' | (SEQ ID NO: 1415) |
| | 3'-UUUUGUAAGGACACUUUCCGUGAAAAG-5' | (SEQ ID NO: 647) |
| TTR-732 Target: | 5'-AAAACATTCCTGTGAAAGGCACTTTTC-3' | (SEQ ID NO: 1031) |
| | 5'-ACAUUCCUGUGAAAGGCACUUUUCA-3' | (SEQ ID NO: 1416) |
| | 3'-UUUGUAAGGACACUUUCCGUGAAAAGU-5' | (SEQ ID NO: 648) |
| TTR-733 Target: | 5'-AAACATTCCTGTGAAAGGCACTTTTCA-3' | (SEQ ID NO: 1032) |
| | 5'-CAUUCCUGUGAAAGGCACUUUUCAU-3' | (SEQ ID NO: 1417) |
| | 3'-UUGUAAGGACACUUUCCGUGAAAAGUA-5' | (SEQ ID NO: 649) |
| TTR-734 Target: | 5'-AACATTCCTGTGAAAGGCACTTTTCAT-3' | (SEQ ID NO: 1033) |
| | 5'-AUUCCUGUGAAAGGCACUUUUCAUU-3' | (SEQ ID NO: 1418) |
| | 3'-UGUAAGGACACUUUCCGUGAAAAGUAA-5' | (SEQ ID NO: 650) |
| TTR-735 Target: | 5'-ACATTCCTGTGAAAGGCACTTTTCATT-3' | (SEQ ID NO: 1034) |
| | 5'-UUCCUGUGAAAGGCACUUUUCAUUC-3' | (SEQ ID NO: 1419) |
| | 3'-GUAAGGACACUUUCCGUGAAAAGUAAG-5' | (SEQ ID NO: 651) |
| TTR-736 Target: | 5'-CATTCCTGTGAAAGGCACTTTTCATTC-3' | (SEQ ID NO: 1035) |
| | 5'-CCUGUGAAAGGCACUUUUCAUUCCA-3' | (SEQ ID NO: 1420) |
| | 3'-AAGGACACUUUCCGUGAAAAGUAAGGU-5' | (SEQ ID NO: 652) |
| TTR-738 Target: | 5'-TTCCTGTGAAAGGCACTTTTCATTCCA-3' | (SEQ ID NO: 1036) |
| | 5'-CUGUGAAAGGCACUUUUCAUUCCAC-3' | (SEQ ID NO: 1421) |
| | 3'-AGGACACUUUCCGUGAAAAGUAAGGUG-5' | (SEQ ID NO: 653) |
| TTR-739 Target: | 5'-TCCTGTGAAAGGCACTTTTCATTCCAC-3' | (SEQ ID NO: 1037) |
| | 5'-UGUGAAAGGCACUUUUCAUUCCACU-3' | (SEQ ID NO: 1422) |
| | 3'-GGACACUUUCCGUGAAAAGUAAGGUGA-5' | (SEQ ID NO: 654) |
| TTR-740 Target: | 5'-CCTGTGAAAGGCACTTTTCATTCCACT-3' | (SEQ ID NO: 1038) |
| | 5'-GUGAAAGGCACUUUUCAUUCCACUU-3' | (SEQ ID NO: 1423) |
| | 3'-GACACUUUCCGUGAAAAGUAAGGUGAA-5' | (SEQ ID NO: 655) |
| TTR-741 Target: | 5'-CTGTGAAAGGCACTTTTCATTCCACTT-3' | (SEQ ID NO: 1039) |
| | 5'-UGAAAGGCACUUUUCAUUCCACUUU-3' | (SEQ ID NO: 1424) |
| | 3'-ACACUUUCCGUGAAAAGUAAGGUGAAA-5' | (SEQ ID NO: 656) |
| TTR-742 Target: | 5'-TGTGAAAGGCACTTTTCATTCCACTTT-3' | (SEQ ID NO: 1040) |
| | 5'-GAAAGGCACUUUUCAUUCCACUUUA-3' | (SEQ ID NO: 1425) |
| | 3'-CACUUUCCGUGAAAAGUAAGGUGAAAU-5' | (SEQ ID NO: 657) |
| TTR-743 Target: | 5'-GTGAAAGGCACTTTTCATTCCACTTTA-3' | (SEQ ID NO: 1041) |
| | 5'-AAAGGCACUUUUCAUUCCACUUUAA-3' | (SEQ ID NO: 1426) |
| | 3'-ACUUUCCGUGAAAAGUAAGGUGAAAUU-5' | (SEQ ID NO: 658) |
| TTR-744 Target: | 5'-TGAAAGGCACTTTTCATTCCACTTTAA-3' | (SEQ ID NO: 1042) |
| | 5'-AAGGCACUUUUCAUUCCACUUUAAC-3' | (SEQ ID NO: 1427) |
| | 3'-CUUUCCGUGAAAAGUAAGGUGAAAUUG-5' | (SEQ ID NO: 659) |
| TTR-745 Target: | 5'-GAAAGGCACTTTTCATTCCACTTTAAC-3' | (SEQ ID NO: 1043) |
| | 5'-AGGCACUUUUCAUUCCACUUUAACU-3' | (SEQ ID NO: 1428) |
| | 3'-UUUCCGUGAAAAGUAAGGUGAAAUUGA-5' | (SEQ ID NO: 660) |
| TTR-746 Target: | 5'-AAAGGCACTTTTCATTCCACTTTAACT-3' | (SEQ ID NO: 1044) |
| | 5'-GGCACUUUUCAUUCCACUUUAACUU-3' | (SEQ ID NO: 1429) |
| | 3'-UUCCGUGAAAAGUAAGGUGAAAUUGAA-5' | (SEQ ID NO: 661) |
| TTR-747 Target: | 5'-AAGGCACTTTTCATTCCACTTTAACTT-3' | (SEQ ID NO: 1045) |
| | 5'-GCACUUUUCAUUCCACUUUAACUUG-3' | (SEQ ID NO: 1430) |
| | 3'-UCCGUGAAAAGUAAGGUGAAAUUGAAC-5' | (SEQ ID NO: 662) |
| TTR-748 Target: | 5'-AGGCACTTTTCATTCCACTTTAACTTG-3' | (SEQ ID NO: 1046) |
| | 5'-CACUUUUCAUUCCACUUUAACUUGA-3' | (SEQ ID NO: 1431) |
| | 3'-CCGUGAAAAGUAAGGUGAAAUUGAACU-5' | (SEQ ID NO: 663) |
| TTR-749 Target: | 5'-GGCACTTTTCATTCCACTTTAACTTGA-3' | (SEQ ID NO: 1047) |
| | 5'-ACUUUUCAUUCCACUUUAACUUGAU-3' | (SEQ ID NO: 1432) |
| | 3'-CGUGAAAAGUAAGGUGAAAUUGAACUA-5' | (SEQ ID NO: 664) |
| TTR-750 Target: | 5'-GCACTTTTCATTCCACTTTAACTTGAT-3' | (SEQ ID NO: 1048) |

TABLE 3-continued

Selected Human Anti-transthyretin DsiRNAs, Unmodified Duplexes
(Asymmetrics)

| | | |
|---|---|---|
| | 5'-CUUUUCAUUCCACUUUAACUUGAUU-3' | (SEQ ID NO: 1433) |
| | 3'-GUGAAAAGUAAGGUGAAAUUGAACUAA-5' | (SEQ ID NO: 665) |
| TTR-751 Target: | 5'-CACTTTTCATTCCACTTTAACTTGATT-3' | (SEQ ID NO: 1049) |
| | 5'-UUUUCAUUCCACUUUAACUUGAUUU-3' | (SEQ ID NO: 1434) |
| | 3'-UGAAAAGUAAGGUGAAAUUGAACUAAA-5' | (SEQ ID NO: 666) |
| TTR-752 Target: | 5'-ACTTTTCATTCCACTTTAACTTGATTT-3' | (SEQ ID NO: 1050) |
| | 5'-UUUCAUUCCACUUUAACUUGAUUUU-3' | (SEQ ID NO: 1435) |
| | 3'-GAAAAGUAAGGUGAAAUUGAACUAAAA-5' | (SEQ ID NO: 667) |
| TTR-753 Target: | 5'-CTTTTCATTCCACTTTAACTTGATTTT-3' | (SEQ ID NO: 1051) |
| | 5'-UUCAUUCCACUUUAACUUGAUUUUU-3' | (SEQ ID NO: 1436) |
| | 3'-AAAAGUAAGGUGAAAUUGAACUAAAAA-5' | (SEQ ID NO: 668) |
| TTR-754 Target: | 5'-TTTTCATTCCACTTTAACTTGATTTTT-3' | (SEQ ID NO: 1052) |
| | 5'-UCAUUCCACUUUAACUUGAUUUUUU-3' | (SEQ ID NO: 1437) |
| | 3'-AAAGUAAGGUGAAAUUGAACUAAAAAA-5' | (SEQ ID NO: 669) |
| TTR-755 Target: | 5'-TTTCATTCCACTTTAACTTGATTTTTT-3' | (SEQ ID NO: 1053) |
| | 5'-CAUUCCACUUUAACUUGAUUUUUUA-3' | (SEQ ID NO: 1438) |
| | 3'-AAGUAAGGUGAAAUUGAACUAAAAAAU-5' | (SEQ ID NO: 670) |
| TTR-756 Target: | 5'-TTCATTCCACTTTAACTTGATTTTTTA-3' | (SEQ ID NO: 1054) |
| | 5'-AUUCCACUUUAACUUGAUUUUUUAA-3' | (SEQ ID NO: 1439) |
| | 3'-AGUAAGGUGAAAUUGAACUAAAAAAUU-5' | (SEQ ID NO: 671) |
| TTR-757 Target: | 5'-TCATTCCACTTTAACTTGATTTTTTAA-3' | (SEQ ID NO: 1055) |
| | 5'-UUCCACUUUAACUUGAUUUUUUAAA-3' | (SEQ ID NO: 1440) |
| | 3'-GUAAGGUGAAAUUGAACUAAAAAAUUU-5' | (SEQ ID NO: 672) |
| TTR-758 Target: | 5'-CATTCCACTTTAACTTGATTTTTTAAA-3' | (SEQ ID NO: 1056) |
| | 5'-UCCACUUUAACUUGAUUUUUUAAAU-3' | (SEQ ID NO: 1441) |
| | 3'-UAAGGUGAAAUUGAACUAAAAAAUUUA-5' | (SEQ ID NO: 673) |
| TTR-759 Target: | 5'-ATTCCACTTTAACTTGATTTTTTAAAT-3' | (SEQ ID NO: 1057) |
| | 5'-CCACUUUAACUUGAUUUUUUAAAUU-3' | (SEQ ID NO: 1442) |
| | 3'-AAGGUGAAAUUGAACUAAAAAAUUUAA-5' | (SEQ ID NO: 674) |
| TTR-760 Target: | 5'-TTCCACTTTAACTTGATTTTTTAAATT-3' | (SEQ ID NO: 1058) |
| | 5'-CACUUUAACUUGAUUUUUUAAAUUC-3' | (SEQ ID NO: 1443) |
| | 3'-AGGUGAAAUUGAACUAAAAAAUUUAAG-5' | (SEQ ID NO: 675) |
| TTR-761 Target: | 5'-TCCACTTTAACTTGATTTTTTAAATTC-3' | (SEQ ID NO: 1059) |
| | 5'-ACUUUAACUUGAUUUUUUAAAUUCC-3' | (SEQ ID NO: 1444) |
| | 3'-GGUGAAAUUGAACUAAAAAAUUUAAGG-5' | (SEQ ID NO: 676) |
| TTR-762 Target: | 5'-CCACTTTAACTTGATTTTTTAAATTCC-3' | (SEQ ID NO: 1060) |
| | 5'-CUUUAACUUGAUUUUUUAAAUUCCC-3' | (SEQ ID NO: 1445) |
| | 3'-GUGAAAUUGAACUAAAAAAUUUAAGGG-5' | (SEQ ID NO: 677) |
| TTR-763 Target: | 5'-CACTTTAACTTGATTTTTTAAATTCCC-3' | (SEQ ID NO: 1061) |
| | 5'-UUUAACUUGAUUUUUUAAAUUCCCU-3' | (SEQ ID NO: 1446) |
| | 3'-UGAAAUUGAACUAAAAAAUUUAAGGGA-5' | (SEQ ID NO: 678) |
| TTR-764 Target: | 5'-ACTTTAACTTGATTTTTTAAATTCCCT-3' | (SEQ ID NO: 1062) |
| | 5'-UUAACUUGAUUUUUUAAAUUCCCUU-3' | (SEQ ID NO: 1447) |
| | 3'-GAAAUUGAACUAAAAAAUUUAAGGGAA-5' | (SEQ ID NO: 679) |
| TTR-765 Target: | 5'-CTTTAACTTGATTTTTTAAATTCCCTT-3' | (SEQ ID NO: 1063) |
| | 5'-UAACUUGAUUUUUUAAAUUCCCUUA-3' | (SEQ ID NO: 1448) |
| | 3'-AAAUUGAACUAAAAAAUUUAAGGGAAU-5' | (SEQ ID NO: 680) |
| TTR-766 Target: | 5'-TTTAACTTGATTTTTTAAATTCCCTTA-3' | (SEQ ID NO: 1064) |
| | 5'-AACUUGAUUUUUUAAAUUCCCUUAU-3' | (SEQ ID NO: 1449) |
| | 3'-AAUUGAACUAAAAAAUUUAAGGGAAUA-5' | (SEQ ID NO: 681) |
| TTR-767 Target: | 5'-TTAACTTGATTTTTTAAATTCCCTTAT-3' | (SEQ ID NO: 1065) |
| | 5'-ACUUGAUUUUUUAAAUUCCCUUAUU-3' | (SEQ ID NO: 1450) |
| | 3'-AUUGAACUAAAAAAUUUAAGGGAAUAA-5' | (SEQ ID NO: 682) |
| TTR-768 Target: | 5'-TAACTTGATTTTTTAAATTCCCTTATT-3' | (SEQ ID NO: 1066) |
| | 5'-CUUGAUUUUUUAAAUUCCCUUAUUG-3' | (SEQ ID NO: 1451) |
| | 3'-UUGAACUAAAAAAUUUAAGGGAAUAAC-5' | (SEQ ID NO: 683) |
| TTR-769 Target: | 5'-AACTTGATTTTTAAATTCCCTTATG-3' | (SEQ ID NO: 1067) |

TABLE 3-continued

Selected Human Anti-transthyretin DsiRNAs, Unmodified Duplexes (Asymmetrics)

| | | |
|---|---|---|
| TTR-770 Target: | 5'-UUGAUUUUUAAAUUCCCUUAUUGU-3'<br>3'-UGAACUAAAAAUUUAAGGGAAUAACA-5'<br>5'-ACTTGATTTTTAAATTCCCTTATTGT-3' | (SEQ ID NO: 1452)<br>(SEQ ID NO: 684)<br>(SEQ ID NO: 1068) |
| TTR-771 Target: | 5'-UGAUUUUUAAAUUCCCUUAUUGUC-3'<br>3'-GAACUAAAAAUUUAAGGGAAUAACAG-5'<br>5'-CTTGATTTTTAAATTCCCTTATTGTC-3' | (SEQ ID NO: 1453)<br>(SEQ ID NO: 685)<br>(SEQ ID NO: 1069) |
| TTR-772 Target: | 5'-GAUUUUUAAAUUCCCUUAUUGUCC-3'<br>3'-AACUAAAAAUUUAAGGGAAUAACAGG-5'<br>5'-TTGATTTTTAAATTCCCTTATTGTCC-3' | (SEQ ID NO: 1454)<br>(SEQ ID NO: 686)<br>(SEQ ID NO: 1070) |
| TTR-773 Target: | 5'-AUUUUUAAAUUCCCUUAUUGUCCC-3'<br>3'-ACUAAAAAUUUAAGGGAAUAACAGGG-5'<br>5'-TGATTTTTAAATTCCCTTATTGTCCC-3' | (SEQ ID NO: 1455)<br>(SEQ ID NO: 687)<br>(SEQ ID NO: 1071) |
| TTR-775 Target: | 5'-UUUUAAAUUCCCUUAUUGUCCCUU-3'<br>3'-UAAAAAUUUAAGGGAAUAACAGGGAA-5'<br>5'-ATTTTTAAATTCCCTTATTGTCCCTT-3' | (SEQ ID NO: 1456)<br>(SEQ ID NO: 688)<br>(SEQ ID NO: 1072) |
| TTR-780 Target: | 5'-AAAUUCCCUUAUUGUCCCUUCCAAA-3'<br>3'-AAUUUAAGGGAAUAACAGGGAAGGUUU-5'<br>5'-TTAAATTCCCTTATTGTCCCTTCCAAA-3' | (SEQ ID NO: 1457)<br>(SEQ ID NO: 689)<br>(SEQ ID NO: 1073) |
| TTR-781 Target: | 5'-AAUUCCCUUAUUGUCCCUUCCAAAA-3'<br>3'-AUUUAAGGGAAUAACAGGGAAGGUUUU-5'<br>5'-TAAATTCCCTTATTGTCCCTTCCAAAA-3' | (SEQ ID NO: 1458)<br>(SEQ ID NO: 690)<br>(SEQ ID NO: 1074) |
| TTR-784 Target: | 5'-UCCCUUAUUGUCCCUUCCAAAAAAA-3'<br>3'-UAAGGGAAUAACAGGGAAGGUUUUUUU-5'<br>5'-ATTCCCTTATTGTCCCTTCCAAAAAAA-3' | (SEQ ID NO: 1459)<br>(SEQ ID NO: 691)<br>(SEQ ID NO: 1075) |
| TTR-805 Target: | 5'-AAAAAGAGAAUCAAAAUUUUACAAA-3'<br>3'-UUUUUUUCUCUUAGUUUUAAAAUGUUU-5'<br>5'-AAAAAAGAGAATCAAAATTTTACAAA-3' | (SEQ ID NO: 1460)<br>(SEQ ID NO: 692)<br>(SEQ ID NO: 1076) |
| TTR-806 Target: | 5'-AAAAGAGAAUCAAAAUUUUACAAAG-3'<br>3'-UUUUUUCUCUUAGUUUUAAAAUGUUUC-5'<br>5'-AAAAAAGAGAATCAAAATTTTACAAAG-3' | (SEQ ID NO: 1461)<br>(SEQ ID NO: 693)<br>(SEQ ID NO: 1077) |
| TTR-807 Target: | 5'-AAAGAGAAUCAAAAUUUUACAAAGA-3'<br>3'-UUUUUCUCUUAGUUUUAAAAUGUUUCU-5'<br>5'-AAAAAGAGAATCAAAATTTTACAAAGA-3' | (SEQ ID NO: 1462)<br>(SEQ ID NO: 694)<br>(SEQ ID NO: 1078) |
| TTR-808 Target: | 5'-AAGAGAAUCAAAAUUUUACAAAGAA-3'<br>3'-UUUUCUCUUAGUUUUAAAAUGUUUCUU-5'<br>5'-AAAAGAGAATCAAAATTTTACAAAGAA-3' | (SEQ ID NO: 1463)<br>(SEQ ID NO: 695)<br>(SEQ ID NO: 1079) |
| TTR-809 Target: | 5'-AGAGAAUCAAAAUUUUACAAAGAAU-3'<br>3'-UUUCUCUUAGUUUUAAAAUGUUUCUUA-5'<br>5'-AAAGAGAATCAAAATTTTACAAAGAAT-3' | (SEQ ID NO: 1464)<br>(SEQ ID NO: 696)<br>(SEQ ID NO: 1080) |
| TTR-810 Target: | 5'-GAGAAUCAAAAUUUUACAAAGAAUC-3'<br>3'-UUCUCUUAGUUUUAAAAUGUUUCUUAG-5'<br>5'-AAGAGAATCAAAATTTTACAAAGAATC-3' | (SEQ ID NO: 1465)<br>(SEQ ID NO: 697)<br>(SEQ ID NO: 1081) |
| TTR-811 Target: | 5'-AGAAUCAAAAUUUUACAAAGAAUCA-3'<br>3'-UCUCUUAGUUUUAAAAUGUUUCUUAGU-5'<br>5'-AGAGAATCAAAATTTTACAAAGAATCA-3' | (SEQ ID NO: 1466)<br>(SEQ ID NO: 698)<br>(SEQ ID NO: 1082) |
| TTR-812 Target: | 5'-GAAUCAAAAUUUUACAAAGAAUCAA-3'<br>3'-CUCUUAGUUUUAAAAUGUUUCUUAGUU-5'<br>5'-GAGAATCAAAATTTTACAAAGAATCAA-3' | (SEQ ID NO: 1467)<br>(SEQ ID NO: 699)<br>(SEQ ID NO: 1083) |
| TTR-813 Target: | 5'-AAUCAAAAUUUUACAAAGAAUCAAA-3'<br>3'-UCUUAGUUUUAAAAUGUUUCUUAGUUU-5'<br>5'-AGAATCAAAATTTTACAAAGAATCAAA-3' | (SEQ ID NO: 1468)<br>(SEQ ID NO: 700)<br>(SEQ ID NO: 1084) |
| TTR-814 Target: | 5'-AUCAAAAUUUUACAAAGAAUCAAAG-3'<br>3'-CUUAGUUUUAAAAUGUUUCUUAGUUUC-5'<br>5'-GAATCAAAATTTTACAAAGAATCAAAG-3' | (SEQ ID NO: 1469)<br>(SEQ ID NO: 701)<br>(SEQ ID NO: 1085) |
| TTR-815 Target: | 5'-UCAAAAUUUUACAAAGAAUCAAAGG-3'<br>3'-UUAGUUUUAAAAUGUUUCUUAGUUUCC-5'<br>5'-AATCAAAATTTTACAAAGAATCAAAGG-3' | (SEQ ID NO: 1470)<br>(SEQ ID NO: 702)<br>(SEQ ID NO: 1086) |

TABLE 3-continued

Selected Human Anti-transthyretin DsiRNAs, Unmodified Duplexes
(Asymmetrics)

|  |  |  |
|---|---|---|
|  | 5'-CAAAAUUUUACAAAGAAUCAAAGGA-3' | (SEQ ID NO: 1471) |
|  | 3'-UAGUUUUAAAAUGUUUCUUAGUUUCCU-5' | (SEQ ID NO: 703) |
| TTR-816 Target: | 5'-ATCAAAATTTTACAAAGAATCAAAGGA-3' | (SEQ ID NO: 1087) |
|  | 5'-AAAAUUUUACAAAGAAUCAAAGGAA-3' | (SEQ ID NO: 1472) |
|  | 3'-AGUUUUAAAAUGUUUCUUAGUUUCCUU-5' | (SEQ ID NO: 704) |
| TTR-817 Target: | 5'-TCAAAATTTTACAAAGAATCAAAGGAA-3' | (SEQ ID NO: 1088) |
|  | 5'-AAAUUUUACAAAGAAUCAAAGGAAU-3' | (SEQ ID NO: 1473) |
|  | 3'-GUUUUAAAAUGUUUCUUAGUUUCCUUA-5' | (SEQ ID NO: 705) |
| TTR-818 Target: | 5'-CAAAATTTTACAAAGAATCAAAGGAAT-3' | (SEQ ID NO: 1089) |
|  | 5'-AAUUUUACAAAGAAUCAAAGGAAUU-3' | (SEQ ID NO: 1474) |
|  | 3'-UUUUAAAAUGUUUCUUAGUUUCCUUAA-5' | (SEQ ID NO: 706) |
| TTR-819 Target: | 5'-AAAATTTTACAAAGAATCAAAGGAATT-3' | (SEQ ID NO: 1090) |
|  | 5'-UUUUACAAAGAAUCAAAGGAAUUCU-3' | (SEQ ID NO: 1475) |
|  | 3'-UUAAAAUGUUUCUUAGUUUCCUUAAGA-5' | (SEQ ID NO: 707) |
| TTR-821 Target: | 5'-AATTTTACAAAGAATCAAAGGAATTCT-3' | (SEQ ID NO: 1091) |
|  | 5'-UUUACAAAGAAUCAAAGGAAUUCUA-3' | (SEQ ID NO: 1476) |
|  | 3'-UAAAAUGUUUCUUAGUUUCCUUAAGAU-5' | (SEQ ID NO: 708) |
| TTR-822 Target: | 5'-ATTTTACAAAGAATCAAAGGAATTCTA-3' | (SEQ ID NO: 1092) |
|  | 5'-UUACAAAGAAUCAAAGGAAUUCUAG-3' | (SEQ ID NO: 1477) |
|  | 3'-AAAAUGUUUCUUAGUUUCCUUAAGAUC-5' | (SEQ ID NO: 709) |
| TTR-823 Target: | 5'-TTTTACAAAGAATCAAAGGAATTCTAG-3' | (SEQ ID NO: 1093) |
|  | 5'-UACAAAGAAUCAAAGGAAUUCUAGA-3' | (SEQ ID NO: 1478) |
|  | 3'-AAAUGUUUCUUAGUUUCCUUAAGAUCU-5' | (SEQ ID NO: 710) |
| TTR-824 Target: | 5'-TTTACAAAGAATCAAAGGAATTCTAGA-3' | (SEQ ID NO: 1094) |
|  | 5'-ACAAAGAAUCAAAGGAAUUCUAGAA-3' | (SEQ ID NO: 1479) |
|  | 3'-AAUGUUUCUUAGUUUCCUUAAGAUCUU-5' | (SEQ ID NO: 711) |
| TTR-825 Target: | 5'-TTACAAAGAATCAAAGGAATTCTAGAA-3' | (SEQ ID NO: 1095) |
|  | 5'-CAAAGAAUCAAAGGAAUUCUAGAAA-3' | (SEQ ID NO: 1480) |
|  | 3'-AUGUUUCUUAGUUUCCUUAAGAUCUUU-5' | (SEQ ID NO: 712) |
| TTR-826 Target: | 5'-TACAAAGAATCAAAGGAATTCTAGAAA-3' | (SEQ ID NO: 1096) |
|  | 5'-AAAGAAUCAAAGGAAUUCUAGAAAG-3' | (SEQ ID NO: 1481) |
|  | 3'-UGUUUCUUAGUUUCCUUAAGAUCUUUC-5' | (SEQ ID NO: 713) |
| TTR-827 Target: | 5'-ACAAAGAATCAAAGGAATTCTAGAAAG-3' | (SEQ ID NO: 1097) |
|  | 5'-AAGAAUCAAAGGAAUUCUAGAAAGU-3' | (SEQ ID NO: 1482) |
|  | 3'-GUUUCUUAGUUUCCUUAAGAUCUUUCA-5' | (SEQ ID NO: 714) |
| TTR-828 Target: | 5'-CAAAGAATCAAAGGAATTCTAGAAAGT-3' | (SEQ ID NO: 1098) |
|  | 5'-AGAAUCAAAGGAAUUCUAGAAAGUA-3' | (SEQ ID NO: 1483) |
|  | 3'-UUUCUUAGUUUCCUUAAGAUCUUUCAU-5' | (SEQ ID NO: 715) |
| TTR-829 Target: | 5'-AAAGAATCAAAGGAATTCTAGAAAGTA-3' | (SEQ ID NO: 1099) |
|  | 5'-GAAUCAAAGGAAUUCUAGAAAGUAU-3' | (SEQ ID NO: 1484) |
|  | 3'-UUCUUAGUUUCCUUAAGAUCUUUCAUA-5' | (SEQ ID NO: 716) |
| TTR-830 Target: | 5'-AAGAATCAAAGGAATTCTAGAAAGTAT-3' | (SEQ ID NO: 1100) |
|  | 5'-AAUCAAAGGAAUUCUAGAAAGUAUC-3' | (SEQ ID NO: 1485) |
|  | 3'-UCUUAGUUUCCUUAAGAUCUUUCAUAG-5' | (SEQ ID NO: 717) |
| TTR-831 Target: | 5'-AGAATCAAAGGAATTCTAGAAAGTATC-3' | (SEQ ID NO: 1101) |
|  | 5'-AUCAAAGGAAUUCUAGAAAGUAUCU-3' | (SEQ ID NO: 1486) |
|  | 3'-CUUAGUUUCCUUAAGAUCUUUCAUAGA-5' | (SEQ ID NO: 718) |
| TTR-832 Target: | 5'-GAATCAAAGGAATTCTAGAAAGTATCT-3' | (SEQ ID NO: 1102) |
|  | 5'-UCAAAGGAAUUCUAGAAAGUAUCUG-3' | (SEQ ID NO: 1487) |
|  | 3'-UUAGUUUCCUUAAGAUCUUUCAUAGAC-5' | (SEQ ID NO: 719) |
| TTR-833 Target: | 5'-AATCAAAGGAATTCTAGAAAGTATCTG-3' | (SEQ ID NO: 1103) |
|  | 5'-CAAAGGAAUUCUAGAAAGUAUCUGG-3' | (SEQ ID NO: 1488) |
|  | 3'-UAGUUUCCUUAAGAUCUUUCAUAGACC-5' | (SEQ ID NO: 720) |
| TTR-834 Target: | 5'-ATCAAAGGAATTCTAGAAAGTATCTGG-3' | (SEQ ID NO: 1104) |
|  | 5'-AAAGGAAUUCUAGAAAGUAUCUGGG-3' | (SEQ ID NO: 1489) |
|  | 3'-AGUUUCCUUAAGAUCUUUCAUAGACCC-5' | (SEQ ID NO: 721) |
| TTR-835 Target: | 5'-TCAAAGGAATTCTAGAAAGTATCTGGG-3' | (SEQ ID NO: 1105) |

TABLE 3-continued

Selected Human Anti-transthyretin DsiRNAs, Unmodified Duplexes
(Asymmetrics)

|  |  |  |
|---|---|---|
|  | 5'-AGGAGAGAUCCAAAUUUCCAUUGUC-3' | (SEQ ID NO: 1490) |
|  | 3'-GAUCCUCUCUAGGUUUAAAGGUAACAG-5' | (SEQ ID NO: 722) |
| TTR-869 Target: | 5'-CTAGGAGAGATCCAAATTTCCATTGTC-3' | (SEQ ID NO: 1106) |
|  | 5'-GGAGAGAUCCAAAUUUCCAUUGUCU-3' | (SEQ ID NO: 1491) |
|  | 3'-AUCCUCUCUAGGUUUAAAGGUAACAGA-5' | (SEQ ID NO: 723) |
| TTR-870 Target: | 5'-TAGGAGAGATCCAAATTTCCATTGTCT-3' | (SEQ ID NO: 1107) |
|  | 5'-GAGAUCCAAAUUUCCAUUGUCUUGC-3' | (SEQ ID NO: 1492) |
|  | 3'-CUCUCUAGGUUUAAAGGUAACAGAACG-5' | (SEQ ID NO: 724) |
| TTR-873 Target: | 5'-GAGAGATCCAAATTTCCATTGTCTTGC-3' | (SEQ ID NO: 1108) |
|  | 5'-AGAUCCAAAUUUCCAUUGUCUUGCA-3' | (SEQ ID NO: 1493) |
|  | 3'-UCUCUAGGUUUAAAGGUAACAGAACGU-5' | (SEQ ID NO: 725) |
| TTR-874 Target: | 5'-AGAGATCCAAATTTCCATTGTCTTGCA-3' | (SEQ ID NO: 1109) |
|  | 5'-GAUCCAAAUUUCCAUUGUCUUGCAA-3' | (SEQ ID NO: 1494) |
|  | 3'-CUCUAGGUUUAAAGGUAACAGAACGUU-5' | (SEQ ID NO: 726) |
| TTR-875 Target: | 5'-GAGATCCAAATTTCCATTGTCTTGCAA-3' | (SEQ ID NO: 1110) |
|  | 5'-AUCCAAAUUUCCAUUGUCUUGCAAG-3' | (SEQ ID NO: 1495) |
|  | 3'-UCUAGGUUUAAAGGUAACAGAACGUUC-5' | (SEQ ID NO: 727) |
| TTR-876 Target: | 5'-AGATCCAAATTTCCATTGTCTTGCAAG-3' | (SEQ ID NO: 1111) |
|  | 5'-UCCAAAUUUCCAUUGUCUUGCAAGC-3' | (SEQ ID NO: 1496) |
|  | 3'-CUAGGUUUAAAGGUAACAGAACGUUCG-5' | (SEQ ID NO: 728) |
| TTR-877 Target: | 5'-GATCCAAATTTCCATTGTCTTGCAAGC-3' | (SEQ ID NO: 1112) |
|  | 5'-CCAAAUUUCCAUUGUCUUGCAAGCA-3' | (SEQ ID NO: 1497) |
|  | 3'-UAGGUUUAAAGGUAACAGAACGUUCGU-5' | (SEQ ID NO: 729) |
| TTR-878 Target: | 5'-ATCCAAATTTCCATTGTCTTGCAAGCA-3' | (SEQ ID NO: 1113) |
|  | 5'-CAAAUUUCCAUUGUCUUGCAAGCAA-3' | (SEQ ID NO: 1498) |
|  | 3'-AGGUUUAAAGGUAACAGAACGUUCGUU-5' | (SEQ ID NO: 730) |
| TTR-879 Target: | 5'-TCCAAATTTCCATTGTCTTGCAAGCAA-3' | (SEQ ID NO: 1114) |
|  | 5'-AAAUUUCCAUUGUCUUGCAAGCAAA-3' | (SEQ ID NO: 1499) |
|  | 3'-GGUUUAAAGGUAACAGAACGUUCGUUU-5' | (SEQ ID NO: 731) |
| TTR-880 Target: | 5'-CCAAATTTCCATTGTCTTGCAAGCAAA-3' | (SEQ ID NO: 1115) |
|  | 5'-AAUUUCCAUUGUCUUGCAAGCAAAG-3' | (SEQ ID NO: 1500) |
|  | 3'-GUUUAAAGGUAACAGAACGUUCGUUUC-5' | (SEQ ID NO: 732) |
| TTR-881 Target: | 5'-CAAATTTCCATTGTCTTGCAAGCAAAG-3' | (SEQ ID NO: 1116) |
|  | 5'-AUUUCCAUUGUCUUGCAAGCAAAGC-3' | (SEQ ID NO: 1501) |
|  | 3'-UUUAAAGGUAACAGAACGUUCGUUUCG-5' | (SEQ ID NO: 733) |
| TTR-882 Target: | 5'-AAATTTCCATTGTCTTGCAAGCAAAGC-3' | (SEQ ID NO: 1117) |
|  | 5'-UUUCCAUUGUCUUGCAAGCAAAGCA-3' | (SEQ ID NO: 1502) |
|  | 3'-UUAAAGGUAACAGAACGUUCGUUUCGU-5' | (SEQ ID NO: 734) |
| TTR-883 Target: | 5'-AATTTCCATTGTCTTGCAAGCAAAGCA-3' | (SEQ ID NO: 1118) |
|  | 5'-UUCCAUUGUCUUGCAAGCAAAGCAC-3' | (SEQ ID NO: 1503) |
|  | 3'-UAAAGGUAACAGAACGUUCGUUUCGUG-5' | (SEQ ID NO: 735) |
| TTR-884 Target: | 5'-ATTTCCATTGTCTTGCAAGCAAAGCAC-3' | (SEQ ID NO: 1119) |
|  | 5'-UCCAUUGUCUUGCAAGCAAAGCACG-3' | (SEQ ID NO: 1504) |
|  | 3'-AAAGGUAACAGAACGUUCGUUUCGUGC-5' | (SEQ ID NO: 736) |
| TTR-885 Target: | 5'-TTTCCATTGTCTTGCAAGCAAAGCACG-3' | (SEQ ID NO: 1120) |
|  | 5'-CCAUUGUCUUGCAAGCAAAGCACGU-3' | (SEQ ID NO: 1505) |
|  | 3'-AAGGUAACAGAACGUUCGUUUCGUGCA-5' | (SEQ ID NO: 737) |
| TTR-886 Target: | 5'-TTCCATTGTCTTGCAAGCAAAGCACGT-3' | (SEQ ID NO: 1121) |
|  | 5'-CAUUGUCUUGCAAGCAAAGCACGUA-3' | (SEQ ID NO: 1506) |
|  | 3'-AGGUAACAGAACGUUCGUUUCGUGCAU-5' | (SEQ ID NO: 738) |
| TTR-887 Target: | 5'-TCCATTGTCTTGCAAGCAAAGCACGTA-3' | (SEQ ID NO: 1122) |
|  | 5'-AUUGUCUUGCAAGCAAAGCACGUAU-3' | (SEQ ID NO: 1507) |
|  | 3'-GGUAACAGAACGUUCGUUUCGUGCAUA-5' | (SEQ ID NO: 739) |
| TTR-888 Target: | 5'-CCATTGTCTTGCAAGCAAAGCACGTAT-3' | (SEQ ID NO: 1123) |
|  | 5'-UUGUCUUGCAAGCAAAGCACGUAUU-3' | (SEQ ID NO: 1508) |
|  | 3'-GUAACAGAACGUUCGUUUCGUGCAUAA-5' | (SEQ ID NO: 740) |
| TTR-889 Target: | 5'-CATTGTCTTGCAAGCAAAGCACGTATT-3' | (SEQ ID NO: 1124) |

TABLE 3-continued

Selected Human Anti-transthyretin DsiRNAs, Unmodified Duplexes
(Asymmetrics)

| | | |
|---|---|---|
| TTR-890 | 5'-UGUCUUGCAAGCAAAGCACGUAUUA-3'<br>3'-UAACAGAACGUUCGUUUCGUGCAUAAU-5'<br>Target: 5'-ATTGTCTTGCAAGCAAAGCACGTATTA-3' | (SEQ ID NO: 1509)<br>(SEQ ID NO: 741)<br>(SEQ ID NO: 1125) |
| TTR-891 | 5'-GUCUUGCAAGCAAAGCACGUAUUAA-3'<br>3'-AACAGAACGUUCGUUUCGUGCAUAAUU-5'<br>Target: 5'-TTGTCTTGCAAGCAAAGCACGTATTAA-3' | (SEQ ID NO: 1510)<br>(SEQ ID NO: 742)<br>(SEQ ID NO: 1126) |
| TTR-892 | 5'-UCUUGCAAGCAAAGCACGUAUUAAA-3'<br>3'-ACAGAACGUUCGUUUCGUGCAUAAUUU-5'<br>Target: 5'-TGTCTTGCAAGCAAAGCACGTATTAAA-3' | (SEQ ID NO: 1511)<br>(SEQ ID NO: 743)<br>(SEQ ID NO: 1127) |
| TTR-893 | 5'-CUUGCAAGCAAAGCACGUAUUAAAU-3'<br>3'-CAGAACGUUCGUUUCGUGCAUAAUUUA-5'<br>Target: 5'-GTCTTGCAAGCAAAGCACGTATTAAAT-3' | (SEQ ID NO: 1512)<br>(SEQ ID NO: 744)<br>(SEQ ID NO: 1128) |
| TTR-894 | 5'-UUGCAAGCAAAGCACGUAUUAAAUA-3'<br>3'-AGAACGUUCGUUUCGUGCAUAAUUUAU-5'<br>Target: 5'-TCTTGCAAGCAAAGCACGTATTAAATA-3' | (SEQ ID NO: 1513)<br>(SEQ ID NO: 745)<br>(SEQ ID NO: 1129) |
| TTR-895 | 5'-UGCAAGCAAAGCACGUAUUAAAUAU-3'<br>3'-GAACGUUCGUUUCGUGCAUAAUUUAUA-5'<br>Target: 5'-CTTGCAAGCAAAGCACGTATTAAATAT-3' | (SEQ ID NO: 1514)<br>(SEQ ID NO: 746)<br>(SEQ ID NO: 1130) |
| TTR-896 | 5'-GCAAGCAAAGCACGUAUUAAAUAUG-3'<br>3'-AACGUUCGUUUCGUGCAUAAUUUAUAC-5'<br>Target: 5'-TTGCAAGCAAAGCACGTATTAAATATG-3' | (SEQ ID NO: 1515)<br>(SEQ ID NO: 747)<br>(SEQ ID NO: 1131) |
| TTR-897 | 5'-CAAGCAAAGCACGUAUUAAAUAUGA-3'<br>3'-ACGUUCGUUUCGUGCAUAAUUUAUACU-5'<br>Target: 5'-TGCAAGCAAAGCACGTATTAAATATGA-3' | (SEQ ID NO: 1516)<br>(SEQ ID NO: 748)<br>(SEQ ID NO: 1132) |
| TTR-898 | 5'-AAGCAAAGCACGUAUUAAAUAUGAU-3'<br>3'-CGUUCGUUUCGUGCAUAAUUUAUACUA-5'<br>Target: 5'-GCAAGCAAAGCACGTATTAAATATGAT-3' | (SEQ ID NO: 1517)<br>(SEQ ID NO: 749)<br>(SEQ ID NO: 1133) |
| TTR-899 | 5'-AGCAAAGCACGUAUUAAAUAUGAUC-3'<br>3'-GUUCGUUUCGUGCAUAAUUUAUACUAG-5'<br>Target: 5'-CAAGCAAAGCACGTATTAAATATGATC-3' | (SEQ ID NO: 1518)<br>(SEQ ID NO: 750)<br>(SEQ ID NO: 1134) |
| TTR-900 | 5'-GCAAAGCACGUAUUAAAUAUGAUCU-3'<br>3'-UUCGUUUCGUGCAUAAUUUAUACUAGA-5'<br>Target: 5'-AAGCAAAGCACGTATTAAATATGATCT-3' | (SEQ ID NO: 1519)<br>(SEQ ID NO: 751)<br>(SEQ ID NO: 1135) |
| TTR-901 | 5'-CAAAGCACGUAUUAAAUAUGAUCUG-3'<br>3'-UCGUUUCGUGCAUAAUUUAUACUAGAC-5'<br>Target: 5'-AGCAAAGCACGTATTAAATATGATCTG-3' | (SEQ ID NO: 1520)<br>(SEQ ID NO: 752)<br>(SEQ ID NO: 1136) |
| TTR-902 | 5'-AAAGCACGUAUUAAAUAUGAUCUGC-3'<br>3'-CGUUUCGUGCAUAAUUUAUACUAGACG-5'<br>Target: 5'-GCAAAGCACGTATTAAATATGATCTGC-3' | (SEQ ID NO: 1521)<br>(SEQ ID NO: 753)<br>(SEQ ID NO: 1137) |
| TTR-903 | 5'-AAGCACGUAUUAAAUAUGAUCUGCA-3'<br>3'-GUUUCGUGCAUAAUUUAUACUAGACGU-5'<br>Target: 5'-CAAAGCACGTATTAAATATGATCTGCA-3' | (SEQ ID NO: 1522)<br>(SEQ ID NO: 754)<br>(SEQ ID NO: 1138) |
| TTR-904 | 5'-AGCACGUAUUAAAUAUGAUCUGCAG-3'<br>3'-UUUCGUGCAUAAUUUAUACUAGACGUC-5'<br>Target: 5'-AAAGCACGTATTAAATATGATCTGCAG-3' | (SEQ ID NO: 1523)<br>(SEQ ID NO: 755)<br>(SEQ ID NO: 1139) |
| TTR-905 | 5'-GCACGUAUUAAAUAUGAUCUGCAGC-3'<br>3'-UUCGUGCAUAAUUUAUACUAGACGUCG-5'<br>Target: 5'-AAGCACGTATTAAATATGATCTGCAGC-3' | (SEQ ID NO: 1524)<br>(SEQ ID NO: 756)<br>(SEQ ID NO: 1140) |
| TTR-906 | 5'-CACGUAUUAAAUAUGAUCUGCAGCC-3'<br>3'-UCGUGCAUAAUUUAUACUAGACGUCGG-5'<br>Target: 5'-AGCACGTATTAAATATGATCTGCAGCC-3' | (SEQ ID NO: 1525)<br>(SEQ ID NO: 757)<br>(SEQ ID NO: 1141) |
| TTR-908 | 5'-CGUAUUAAAUAUGAUCUGCAGCCAU-3'<br>3'-GUGCAUAAUUUAUACUAGACGUCGGUA-5'<br>Target: 5'-CACGTATTAAATATGATCTGCAGCCAT-3' | (SEQ ID NO: 1526)<br>(SEQ ID NO: 758)<br>(SEQ ID NO: 1142) |
| TTR-909 | 5'-GUAUUAAAUAUGAUCUGCAGCCAUU-3'<br>3'-UGCAUAAUUUAUACUAGACGUCGGUAA-5'<br>Target: 5'-ACGTATTAAATATGATCTGCAGCCATT-3' | (SEQ ID NO: 1527)<br>(SEQ ID NO: 759)<br>(SEQ ID NO: 1143) |

TABLE 3-continued

Selected Human Anti-transthyretin DsiRNAs, Unmodified Duplexes (Asymmetrics)

| | | |
|---|---|---|
| | 5'-AUUAAAUAUGAUCUGCAGCCAUUAA-3' | (SEQ ID NO: 1528) |
| | 3'-CAUAAUUUAUACUAGACGUCGGUAAUU-5' | (SEQ ID NO: 760) |
| TTR-911 Target: | 5'-GTATTAAATATGATCTGCAGCCATTAA-3' | (SEQ ID NO: 1144) |
| | 5'-UUAAAUAUGAUCUGCAGCCAUUAAA-3' | (SEQ ID NO: 1529) |
| | 3'-AUAAUUUAUACUAGACGUCGGUAAUUU-5' | (SEQ ID NO: 761) |
| TTR-912 Target: | 5'-TATTAAATATGATCTGCAGCCATTAAA-3' | (SEQ ID NO: 1145) |
| | 5'-UAAAUAUGAUCUGCAGCCAUUAAAA-3' | (SEQ ID NO: 1530) |
| | 3'-UAAUUUAUACUAGACGUCGGUAAUUUU-5' | (SEQ ID NO: 762) |
| TTR-913 Target: | 5'-ATTAAATATGATCTGCAGCCATTAAAA-3' | (SEQ ID NO: 1146) |
| | 5'-AAAUAUGAUCUGCAGCCAUUAAAAA-3' | (SEQ ID NO: 1531) |
| | 3'-AAUUUAUACUAGACGUCGGUAAUUUUU-5' | (SEQ ID NO: 763) |
| TTR-914 Target: | 5'-TTAAATATGATCTGCAGCCATTAAAAA-3' | (SEQ ID NO: 1147) |
| | 5'-AAUAUGAUCUGCAGCCAUUAAAAAG-3' | (SEQ ID NO: 1532) |
| | 3'-AUUUAUACUAGACGUCGGUAAUUUUUC-5' | (SEQ ID NO: 764) |
| TTR-915 Target: | 5'-TAAATATGATCTGCAGCCATTAAAAAG-3' | (SEQ ID NO: 1148) |
| | 5'-AUAUGAUCUGCAGCCAUUAAAAAGA-3' | (SEQ ID NO: 1533) |
| | 3'-UUUAUACUAGACGUCGGUAAUUUUUCU-5' | (SEQ ID NO: 765) |
| TTR-916 Target: | 5'-AAATATGATCTGCAGCCATTAAAAAGA-3' | (SEQ ID NO: 1149) |
| | 5'-UAUGAUCUGCAGCCAUUAAAAAGAC-3' | (SEQ ID NO: 1534) |
| | 3'-UUAUACUAGACGUCGGUAAUUUUUCUG-5' | (SEQ ID NO: 766) |
| TTR-917 Target: | 5'-AATATGATCTGCAGCCATTAAAAAGAC-3' | (SEQ ID NO: 1150) |
| | 5'-AUGAUCUGCAGCCAUUAAAAAGACA-3' | (SEQ ID NO: 1535) |
| | 3'-UAUACUAGACGUCGGUAAUUUUUCUGU-5' | (SEQ ID NO: 767) |
| TTR-918 Target: | 5'-ATATGATCTGCAGCCATTAAAAAGACA-3' | (SEQ ID NO: 1151) |
| | 5'-UGAUCUGCAGCCAUUAAAAAGACAC-3' | (SEQ ID NO: 1536) |
| | 3'-AUACUAGACGUCGGUAAUUUUUCUGUG-5' | (SEQ ID NO: 768) |
| TTR-919 Target: | 5'-TATGATCTGCAGCCATTAAAAAGACAC-3' | (SEQ ID NO: 1152) |

TABLE 4

DsiRNA Target Sequences (21mers) in Transthyretin mRNA

| | | |
|---|---|---|
| TTR-27 21 nt Target: | 5'-GUUGACUAAGUCAAUAAUCAG-3' | (SEQ ID NO: 1537) |
| TTR-28 21 nt Target: | 5'-UUGACUAAGUCAAUAAUCAGA-3' | (SEQ ID NO: 1538) |
| TTR-29 21 nt Target: | 5'-UGACUAAGUCAAUAAUCAGAA-3' | (SEQ ID NO: 1539) |
| TTR-30 21 nt Target: | 5'-GACUAAGUCAAUAAUCAGAAU-3' | (SEQ ID NO: 1540) |
| TTR-31 21 nt Target: | 5'-ACUAAGUCAAUAAUCAGAAUC-3' | (SEQ ID NO: 1541) |
| TTR-32 21 nt Target: | 5'-CUAAGUCAAUAAUCAGAAUCA-3' | (SEQ ID NO: 1542) |
| TTR-33 21 nt Target: | 5'-UAAGUCAAUAAUCAGAAUCAG-3' | (SEQ ID NO: 1543) |
| TTR-34 21 nt Target: | 5'-AAGUCAAUAAUCAGAAUCAGC-3' | (SEQ ID NO: 1544) |
| TTR-35 21 nt Target: | 5'-AGUCAAUAAUCAGAAUCAGCA-3' | (SEQ ID NO: 1545) |
| TTR-36 21 nt Target: | 5'-GUCAAUAAUCAGAAUCAGCAG-3' | (SEQ ID NO: 1546) |
| TTR-37 21 nt Target: | 5'-UCAAUAAUCAGAAUCAGCAGG-3' | (SEQ ID NO: 1547) |
| TTR-38 21 nt Target: | 5'-CAAUAAUCAGAAUCAGCAGGU-3' | (SEQ ID NO: 1548) |
| TTR-39 21 nt Target: | 5'-AAUAAUCAGAAUCAGCAGGUU-3' | (SEQ ID NO: 1549) |
| TTR-40 21 nt Target: | 5'-AUAAUCAGAAUCAGCAGGUUU-3' | (SEQ ID NO: 1550) |
| TTR-41 21 nt Target: | 5'-UAAUCAGAAUCAGCAGGUUUG-3' | (SEQ ID NO: 1551) |
| TTR-43 21 nt Target: | 5'-AUCAGAAUCAGCAGGUUUGCA-3' | (SEQ ID NO: 1552) |
| TTR-44 21 nt Target: | 5'-UCAGAAUCAGCAGGUUUGCAG-3' | (SEQ ID NO: 1553) |

TABLE 4-continued

DsiRNA Target Sequences (21mers) in Transthyretin mRNA

| | | |
|---|---|---|
| TTR-46 21 nt Target: | 5'-AGAAUCAGCAGGUUUGCAGUC-3' | (SEQ ID NO: 1554) |
| TTR-47 21 nt Target: | 5'-GAAUCAGCAGGUUUGCAGUCA-3' | (SEQ ID NO: 1555) |
| TTR-59 21 nt Target: | 5'-UUGCAGUCAGAUUGGCAGGGA-3' | (SEQ ID NO: 1556) |
| TTR-84 21 nt Target: | 5'-CAGCCUAGCUCAGGAGAAGUG-3' | (SEQ ID NO: 1557) |
| TTR-87 21 nt Target: | 5'-CCUAGCUCAGGAGAAGUGAGU-3' | (SEQ ID NO: 1558) |
| TTR-88 21 nt Target: | 5'-CUAGCUCAGGAGAAGUGAGUA-3' | (SEQ ID NO: 1559) |
| TTR-89 21 nt Target: | 5'-UAGCUCAGGAGAAGUGAGUAU-3' | (SEQ ID NO: 1560) |
| TTR-90 21 nt Target: | 5'-AGCUCAGGAGAAGUGAGUAUA-3' | (SEQ ID NO: 1561) |
| TTR-92 21 nt Target: | 5'-CUCAGGAGAAGUGAGUAUAAA-3' | (SEQ ID NO: 1562) |
| TTR-126 21 nt Target: | 5'-GAGCAGCCAUCACAGAAGUCC-3' | (SEQ ID NO: 1563) |
| TTR-127 21 nt Target: | 5'-AGCAGCCAUCACAGAAGUCCA-3' | (SEQ ID NO: 1564) |
| TTR-128 21 nt Target: | 5'-GCAGCCAUCACAGAAGUCCAC-3' | (SEQ ID NO: 1565) |
| TTR-129 21 nt Target: | 5'-CAGCCAUCACAGAAGUCCACU-3' | (SEQ ID NO: 1566) |
| TTR-130 21 nt Target: | 5'-AGCCAUCACAGAAGUCCACUC-3' | (SEQ ID NO: 1567) |
| TTR-131 21 nt Target: | 5'-GCCAUCACAGAAGUCCACUCA-3' | (SEQ ID NO: 1568) |
| TTR-132 21 nt Target: | 5'-CCAUCACAGAAGUCCACUCAU-3' | (SEQ ID NO: 1569) |
| TTR-134 21 nt Target: | 5'-AUCACAGAAGUCCACUCAUUC-3' | (SEQ ID NO: 1570) |
| TTR-135 21 nt Target: | 5'-UCACAGAAGUCCACUCAUUCU-3' | (SEQ ID NO: 1571) |
| TTR-150 21 nt Target: | 5'-CAUUCUUGGCAGGAUGGCUUC-3' | (SEQ ID NO: 1572) |
| TTR-151 21 nt Target: | 5'-AUUCUUGGCAGGAUGGCUUCU-3' | (SEQ ID NO: 1573) |
| TTR-152 21 nt Target: | 5'-UUCUUGGCAGGAUGGCUUCUC-3' | (SEQ ID NO: 1574) |
| TTR-153 21 nt Target: | 5'-UCUUGGCAGGAUGGCUUCUCA-3' | (SEQ ID NO: 1575) |
| TTR-154 21 nt Target: | 5'-CUUGGCAGGAUGGCUUCUCAU-3' | (SEQ ID NO: 1576) |
| TTR-155 21 nt Target: | 5'-UUGGCAGGAUGGCUUCUCAUC-3' | (SEQ ID NO: 1577) |
| TTR-156 21 nt Target: | 5'-UGGCAGGAUGGCUUCUCAUCG-3' | (SEQ ID NO: 1578) |
| TTR-157 21 nt Target: | 5'-GGCAGGAUGGCUUCUCAUCGU-3' | (SEQ ID NO: 1579) |
| TTR-158 21 nt Target: | 5'-GCAGGAUGGCUUCUCAUCGUC-3' | (SEQ ID NO: 1580) |
| TTR-159 21 nt Target: | 5'-CAGGAUGGCUUCUCAUCGUCU-3' | (SEQ ID NO: 1581) |
| TTR-160 21 nt Target: | 5'-AGGAUGGCUUCUCAUCGUCUG-3' | (SEQ ID NO: 1582) |
| TTR-161 21 nt Target: | 5'-GGAUGGCUUCUCAUCGUCUGC-3' | (SEQ ID NO: 1583) |
| TTR-162 21 nt Target: | 5'-GAUGGCUUCUCAUCGUCUGCU-3' | (SEQ ID NO: 1584) |
| TTR-163 21 nt Target: | 5'-AUGGCUUCUCAUCGUCUGCUC-3' | (SEQ ID NO: 1585) |
| TTR-164 21 nt Target: | 5'-UGGCUUCUCAUCGUCUGCUCC-3' | (SEQ ID NO: 1586) |
| TTR-165 21 nt Target: | 5'-GGCUUCUCAUCGUCUGCUCCU-3' | (SEQ ID NO: 1587) |
| TTR-186 21 nt Target: | 5'-CCUCUGCCUUGCUGGACUGGU-3' | (SEQ ID NO: 1588) |
| TTR-187 21 nt Target: | 5'-CUCUGCCUUGCUGGACUGGUA-3' | (SEQ ID NO: 1589) |
| TTR-234 21 nt Target: | 5'-CACCGGUGAAUCCAAGUGUCC-3' | (SEQ ID NO: 1590) |
| TTR-238 21 nt Target: | 5'-GGUGAAUCCAAGUGUCCUCUG-3' | (SEQ ID NO: 1591) |
| TTR-239 21 nt Target: | 5'-GUGAAUCCAAGUGUCCUCUGA-3' | (SEQ ID NO: 1592) |

TABLE 4-continued

DsiRNA Target Sequences (21mers) in Transthyretin mRNA

| | | | |
|---|---|---|---|
| TTR-240 21 nt Target: | 5'-UGAAUCCAAGUGUCCUCUGAU-3' | (SEQ ID NO: 1593) |
| TTR-241 21 nt Target: | 5'-GAAUCCAAGUGUCCUCUGAUG-3' | (SEQ ID NO: 1594) |
| TTR-242 21 nt Target: | 5'-AAUCCAAGUGUCCUCUGAUGG-3' | (SEQ ID NO: 1595) |
| TTR-243 21 nt Target: | 5'-AUCCAAGUGUCCUCUGAUGGU-3' | (SEQ ID NO: 1596) |
| TTR-244 21 nt Target: | 5'-UCCAAGUGUCCUCUGAUGGUC-3' | (SEQ ID NO: 1597) |
| TTR-245 21 nt Target: | 5'-CCAAGUGUCCUCUGAUGGUCA-3' | (SEQ ID NO: 1598) |
| TTR-246 21 nt Target: | 5'-CAAGUGUCCUCUGAUGGUCAA-3' | (SEQ ID NO: 1599) |
| TTR-247 21 nt Target: | 5'-AAGUGUCCUCUGAUGGUCAAA-3' | (SEQ ID NO: 1600) |
| TTR-248 21 nt Target: | 5'-AGUGUCCUCUGAUGGUCAAAG-3' | (SEQ ID NO: 1601) |
| TTR-249 21 nt Target: | 5'-GUGUCCUCUGAUGGUCAAAGU-3' | (SEQ ID NO: 1602) |
| TTR-250 21 nt Target: | 5'-UGUCCUCUGAUGGUCAAAGUU-3' | (SEQ ID NO: 1603) |
| TTR-251 21 nt Target: | 5'-GUCCUCUGAUGGUCAAAGUUC-3' | (SEQ ID NO: 1604) |
| TTR-252 21 nt Target: | 5'-UCCUCUGAUGGUCAAAGUUCU-3' | (SEQ ID NO: 1605) |
| TTR-253 21 nt Target: | 5'-CCUCUGAUGGUCAAAGUUCUA-3' | (SEQ ID NO: 1606) |
| TTR-254 21 nt Target: | 5'-CUCUGAUGGUCAAAGUUCUAG-3' | (SEQ ID NO: 1607) |
| TTR-255 21 nt Target: | 5'-UCUGAUGGUCAAAGUUCUAGA-3' | (SEQ ID NO: 1608) |
| TTR-256 21 nt Target: | 5'-CUGAUGGUCAAAGUUCUAGAU-3' | (SEQ ID NO: 1609) |
| TTR-257 21 nt Target: | 5'-UGAUGGUCAAAGUUCUAGAUG-3' | (SEQ ID NO: 1610) |
| TTR-258 21 nt Target: | 5'-GAUGGUCAAAGUUCUAGAUGC-3' | (SEQ ID NO: 1611) |
| TTR-346 21 nt Target: | 5'-GAGCCAUUUGCCUCUGGGAAA-3' | (SEQ ID NO: 1612) |
| TTR-347 21 nt Target: | 5'-AGCCAUUUGCCUCUGGGAAAA-3' | (SEQ ID NO: 1613) |
| TTR-348 21 nt Target: | 5'-GCCAUUUGCCUCUGGGAAAAC-3' | (SEQ ID NO: 1614) |
| TTR-349 21 nt Target: | 5'-CCAUUUGCCUCUGGGAAAACC-3' | (SEQ ID NO: 1615) |
| TTR-350 21 nt Target: | 5'-CAUUUGCCUCUGGGAAAACCA-3' | (SEQ ID NO: 1616) |
| TTR-351 21 nt Target: | 5'-AUUUGCCUCUGGGAAAACCAG-3' | (SEQ ID NO: 1617) |
| TTR-352 21 nt Target: | 5'-UUUGCCUCUGGGAAAACCAGU-3' | (SEQ ID NO: 1618) |
| TTR-353 21 nt Target: | 5'-UUGCCUCUGGGAAAACCAGUG-3' | (SEQ ID NO: 1619) |
| TTR-354 21 nt Target: | 5'-UGCCUCUGGGAAAACCAGUGA-3' | (SEQ ID NO: 1620) |
| TTR-355 21 nt Target: | 5'-GCCUCUGGGAAAACCAGUGAG-3' | (SEQ ID NO: 1621) |
| TTR-356 21 nt Target: | 5'-CCUCUGGGAAAACCAGUGAGU-3' | (SEQ ID NO: 1622) |
| TTR-357 21 nt Target: | 5'-CUCUGGGAAAACCAGUGAGUC-3' | (SEQ ID NO: 1623) |
| TTR-358 21 nt Target: | 5'-UCUGGGAAAACCAGUGAGUCU-3' | (SEQ ID NO: 1624) |
| TTR-359 21 nt Target: | 5'-CUGGGAAAACCAGUGAGUCUG-3' | (SEQ ID NO: 1625) |
| TTR-360 21 nt Target: | 5'-UGGGAAAACCAGUGAGUCUGG-3' | (SEQ ID NO: 1626) |
| TTR-361 21 nt Target: | 5'-GGGAAAACCAGUGAGUCUGGA-3' | (SEQ ID NO: 1627) |
| TTR-381 21 nt Target: | 5'-AGAGCUGCAUGGGCUCACAAC-3' | (SEQ ID NO: 1628) |
| TTR-382 21 nt Target: | 5'-GAGCUGCAUGGGCUCACAACU-3' | (SEQ ID NO: 1629) |
| TTR-383 21 nt Target: | 5'-AGCUGCAUGGGCUCACAACUG-3' | (SEQ ID NO: 1630) |
| TTR-384 21 nt Target: | 5'-GCUGCAUGGGCUCACAACUGA-3' | (SEQ ID NO: 1631) |

TABLE 4-continued

DsiRNA Target Sequences (21mers) in Transthyretin mRNA

| | | |
|---|---|---|
| TTR-385 21 nt Target: | 5'-CUGCAUGGGCUCACAACUGAG-3' | (SEQ ID NO: 1632) |
| TTR-386 21 nt Target: | 5'-UGCAUGGGCUCACAACUGAGG-3' | (SEQ ID NO: 1633) |
| TTR-387 21 nt Target: | 5'-GCAUGGGCUCACAACUGAGGA-3' | (SEQ ID NO: 1634) |
| TTR-388 21 nt Target: | 5'-CAUGGGCUCACAACUGAGGAG-3' | (SEQ ID NO: 1635) |
| TTR-389 21 nt Target: | 5'-AUGGGCUCACAACUGAGGAGG-3' | (SEQ ID NO: 1636) |
| TTR-390 21 nt Target: | 5'-UGGGCUCACAACUGAGGAGGA-3' | (SEQ ID NO: 1637) |
| TTR-391 21 nt Target: | 5'-GGGCUCACAACUGAGGAGGAA-3' | (SEQ ID NO: 1638) |
| TTR-392 21 nt Target: | 5'-GGCUCACAACUGAGGAGGAAU-3' | (SEQ ID NO: 1639) |
| TTR-393 21 nt Target: | 5'-GCUCACAACUGAGGAGGAAUU-3' | (SEQ ID NO: 1640) |
| TTR-394 21 nt Target: | 5'-CUCACAACUGAGGAGGAAUUU-3' | (SEQ ID NO: 1641) |
| TTR-395 21 nt Target: | 5'-UCACAACUGAGGAGGAAUUUG-3' | (SEQ ID NO: 1642) |
| TTR-396 21 nt Target: | 5'-CACAACUGAGGAGGAAUUUGU-3' | (SEQ ID NO: 1643) |
| TTR-398 21 nt Target: | 5'-CAACUGAGGAGGAAUUUGUAG-3' | (SEQ ID NO: 1644) |
| TTR-399 21 nt Target: | 5'-AACUGAGGAGGAAUUUGUAGA-3' | (SEQ ID NO: 1645) |
| TTR-400 21 nt Target: | 5'-ACUGAGGAGGAAUUUGUAGAA-3' | (SEQ ID NO: 1646) |
| TTR-401 21 nt Target: | 5'-CUGAGGAGGAAUUUGUAGAAG-3' | (SEQ ID NO: 1647) |
| TTR-402 21 nt Target: | 5'-UGAGGAGGAAUUUGUAGAAGG-3' | (SEQ ID NO: 1648) |
| TTR-403 21 nt Target: | 5'-GAGGAGGAAUUUGUAGAAGGG-3' | (SEQ ID NO: 1649) |
| TTR-404 21 nt Target: | 5'-AGGAGGAAUUUGUAGAAGGGA-3' | (SEQ ID NO: 1650) |
| TTR-405 21 nt Target: | 5'-GGAGGAAUUUGUAGAAGGGAU-3' | (SEQ ID NO: 1651) |
| TTR-406 21 nt Target: | 5'-GAGGAAUUUGUAGAAGGGAUA-3' | (SEQ ID NO: 1652) |
| TTR-407 21 nt Target: | 5'-AGGAAUUUGUAGAAGGGAUAU-3' | (SEQ ID NO: 1653) |
| TTR-408 21 nt Target: | 5'-GGAAUUUGUAGAAGGGAUAUA-3' | (SEQ ID NO: 1654) |
| TTR-409 21 nt Target: | 5'-GAAUUUGUAGAAGGGAUAUAC-3' | (SEQ ID NO: 1655) |
| TTR-410 21 nt Target: | 5'-AAUUUGUAGAAGGGAUAUACA-3' | (SEQ ID NO: 1656) |
| TTR-411 21 nt Target: | 5'-AUUUGUAGAAGGGAUAUACAA-3' | (SEQ ID NO: 1657) |
| TTR-412 21 nt Target: | 5'-UUUGUAGAAGGGAUAUACAAA-3' | (SEQ ID NO: 1658) |
| TTR-413 21 nt Target: | 5'-UUGUAGAAGGGAUAUACAAAG-3' | (SEQ ID NO: 1659) |
| TTR-414 21 nt Target: | 5'-UGUAGAAGGGAUAUACAAAGU-3' | (SEQ ID NO: 1660) |
| TTR-415 21 nt Target: | 5'-GUAGAAGGGAUAUACAAAGUG-3' | (SEQ ID NO: 1661) |
| TTR-416 21 nt Target: | 5'-UAGAAGGGAUAUACAAAGUGG-3' | (SEQ ID NO: 1662) |
| TTR-417 21 nt Target: | 5'-AGAAGGGAUAUACAAAGUGGA-3' | (SEQ ID NO: 1663) |
| TTR-418 21 nt Target: | 5'-GAAGGGAUAUACAAAGUGGAA-3' | (SEQ ID NO: 1664) |
| TTR-419 21 nt Target: | 5'-AAGGGAUAUACAAAGUGGAAA-3' | (SEQ ID NO: 1665) |
| TTR-420 21 nt Target: | 5'-AGGGAUAUACAAAGUGGAAAU-3' | (SEQ ID NO: 1666) |
| TTR-421 21 nt Target: | 5'-GGGAUAUACAAAGUGGAAAUA-3' | (SEQ ID NO: 1667) |
| TTR-422 21 nt Target: | 5'-GGAUAUACAAAGUGGAAAUAG-3' | (SEQ ID NO: 1668) |
| TTR-423 21 nt Target: | 5'-GAUAUACAAAGUGGAAAUAGA-3' | (SEQ ID NO: 1669) |
| TTR-424 21 nt Target: | 5'-AUAUACAAAGUGGAAAUAGAC-3' | (SEQ ID NO: 1670) |

TABLE 4-continued

DsiRNA Target Sequences (21mers) in Transthyretin mRNA

| | | | |
|---|---|---|---|
| TTR-425 | 21 nt Target: | 5'-UAUACAAAGUGGAAAUAGACA-3' | (SEQ ID NO: 1671) |
| TTR-426 | 21 nt Target: | 5'-AUACAAAGUGGAAAUAGACAC-3' | (SEQ ID NO: 1672) |
| TTR-427 | 21 nt Target: | 5'-UACAAAGUGGAAAUAGACACC-3' | (SEQ ID NO: 1673) |
| TTR-428 | 21 nt Target: | 5'-ACAAAGUGGAAAUAGACACCA-3' | (SEQ ID NO: 1674) |
| TTR-429 | 21 nt Target: | 5'-CAAAGUGGAAAUAGACACCAA-3' | (SEQ ID NO: 1675) |
| TTR-430 | 21 nt Target: | 5'-AAAGUGGAAAUAGACACCAAA-3' | (SEQ ID NO: 1676) |
| TTR-431 | 21 nt Target: | 5'-AAGUGGAAAUAGACACCAAAU-3' | (SEQ ID NO: 1677) |
| TTR-432 | 21 nt Target: | 5'-AGUGGAAAUAGACACCAAAUC-3' | (SEQ ID NO: 1678) |
| TTR-433 | 21 nt Target: | 5'-GUGGAAAUAGACACCAAAUCU-3' | (SEQ ID NO: 1679) |
| TTR-434 | 21 nt Target: | 5'-UGGAAAUAGACACCAAAUCUU-3' | (SEQ ID NO: 1680) |
| TTR-435 | 21 nt Target: | 5'-GGAAAUAGACACCAAAUCUUA-3' | (SEQ ID NO: 1681) |
| TTR-436 | 21 nt Target: | 5'-GAAAUAGACACCAAAUCUUAC-3' | (SEQ ID NO: 1682) |
| TTR-437 | 21 nt Target: | 5'-AAAUAGACACCAAAUCUUACU-3' | (SEQ ID NO: 1683) |
| TTR-439 | 21 nt Target: | 5'-AUAGACACCAAAUCUUACUGG-3' | (SEQ ID NO: 1684) |
| TTR-440 | 21 nt Target: | 5'-UAGACACCAAAUCUUACUGGA-3' | (SEQ ID NO: 1685) |
| TTR-462 | 21 nt Target: | 5'-GGCACUUGGCAUCUCCCAUU-3' | (SEQ ID NO: 1686) |
| TTR-463 | 21 nt Target: | 5'-GCACUUGGCAUCUCCCAUUC-3' | (SEQ ID NO: 1687) |
| TTR-464 | 21 nt Target: | 5'-CACUUGGCAUCUCCCAUUCC-3' | (SEQ ID NO: 1688) |
| TTR-465 | 21 nt Target: | 5'-ACUUGGCAUCUCCCAUUCCA-3' | (SEQ ID NO: 1689) |
| TTR-466 | 21 nt Target: | 5'-CUUGGCAUCUCCCAUUCCAU-3' | (SEQ ID NO: 1690) |
| TTR-467 | 21 nt Target: | 5'-UUGGCAUCUCCCAUUCCAUG-3' | (SEQ ID NO: 1691) |
| TTR-468 | 21 nt Target: | 5'-UGGCAUCUCCCAUUCCAUGA-3' | (SEQ ID NO: 1692) |
| TTR-469 | 21 nt Target: | 5'-GGCAUCUCCCAUUCCAUGAG-3' | (SEQ ID NO: 1693) |
| TTR-470 | 21 nt Target: | 5'-GCAUCUCCCAUUCCAUGAGC-3' | (SEQ ID NO: 1694) |
| TTR-471 | 21 nt Target: | 5'-CAUCUCCCAUUCCAUGAGCA-3' | (SEQ ID NO: 1695) |
| TTR-472 | 21 nt Target: | 5'-AUCUCCCAUUCCAUGAGCAU-3' | (SEQ ID NO: 1696) |
| TTR-473 | 21 nt Target: | 5'-UCUCCCAUUCCAUGAGCAUG-3' | (SEQ ID NO: 1697) |
| TTR-474 | 21 nt Target: | 5'-CUCCCAUUCCAUGAGCAUGC-3' | (SEQ ID NO: 1698) |
| TTR-482 | 21 nt Target: | 5'-UCCAUGAGCAUGCAGAGGUGG-3' | (SEQ ID NO: 1699) |
| TTR-483 | 21 nt Target: | 5'-CCAUGAGCAUGCAGAGGUGGU-3' | (SEQ ID NO: 1700) |
| TTR-484 | 21 nt Target: | 5'-CAUGAGCAUGCAGAGGUGGUA-3' | (SEQ ID NO: 1701) |
| TTR-485 | 21 nt Target: | 5'-AUGAGCAUGCAGAGGUGGUAU-3' | (SEQ ID NO: 1702) |
| TTR-489 | 21 nt Target: | 5'-GCAUGCAGAGGUGGUAUUCAC-3' | (SEQ ID NO: 1703) |
| TTR-493 | 21 nt Target: | 5'-GCAGAGGUGGUAUUCACAGCC-3' | (SEQ ID NO: 1704) |
| TTR-494 | 21 nt Target: | 5'-CAGAGGUGGUAUUCACAGCCA-3' | (SEQ ID NO: 1705) |
| TTR-581 | 21 nt Target: | 5'-CUGUCGUCACCAAUCCCAAGG-3' | (SEQ ID NO: 1706) |
| TTR-631 | 21 nt Target: | 5'-AAGGACGAGGGAUGGGAUUUC-3' | (SEQ ID NO: 1707) |
| TTR-632 | 21 nt Target: | 5'-AGGACGAGGGAUGGGAUUUCA-3' | (SEQ ID NO: 1708) |
| TTR-635 | 21 nt Target: | 5'-ACGAGGGAUGGGAUUUCAUGU-3' | (SEQ ID NO: 1709) |

TABLE 4-continued

DsiRNA Target Sequences (21mers) in Transthyretin mRNA

| | | | |
|---|---|---|---|
| TTR-636 | 21 nt Target: | 5'-CGAGGGAUGGGAUUUCAUGUA-3' | (SEQ ID NO: 1710) |
| TTR-637 | 21 nt Target: | 5'-GAGGGAUGGGAUUUCAUGUAA-3' | (SEQ ID NO: 1711) |
| TTR-639 | 21 nt Target: | 5'-GGGAUGGGAUUUCAUGUAACC-3' | (SEQ ID NO: 1712) |
| TTR-640 | 21 nt Target: | 5'-GGAUGGGAUUUCAUGUAACCA-3' | (SEQ ID NO: 1713) |
| TTR-641 | 21 nt Target: | 5'-GAUGGGAUUUCAUGUAACCAA-3' | (SEQ ID NO: 1714) |
| TTR-642 | 21 nt Target: | 5'-AUGGGAUUUCAUGUAACCAAG-3' | (SEQ ID NO: 1715) |
| TTR-643 | 21 nt Target: | 5'-UGGGAUUUCAUGUAACCAAGA-3' | (SEQ ID NO: 1716) |
| TTR-644 | 21 nt Target: | 5'-GGGAUUUCAUGUAACCAAGAG-3' | (SEQ ID NO: 1717) |
| TTR-645 | 21 nt Target: | 5'-GGAUUUCAUGUAACCAAGAGU-3' | (SEQ ID NO: 1718) |
| TTR-646 | 21 nt Target: | 5'-GAUUUCAUGUAACCAAGAGUA-3' | (SEQ ID NO: 1719) |
| TTR-647 | 21 nt Target: | 5'-AUUUCAUGUAACCAAGAGUAU-3' | (SEQ ID NO: 1720) |
| TTR-648 | 21 nt Target: | 5'-UUUCAUGUAACCAAGAGUAUU-3' | (SEQ ID NO: 1721) |
| TTR-649 | 21 nt Target: | 5'-UUCAUGUAACCAAGAGUAUUC-3' | (SEQ ID NO: 1722) |
| TTR-650 | 21 nt Target: | 5'-UCAUGUAACCAAGAGUAUUCC-3' | (SEQ ID NO: 1723) |
| TTR-651 | 21 nt Target: | 5'-CAUGUAACCAAGAGUAUUCCA-3' | (SEQ ID NO: 1724) |
| TTR-652 | 21 nt Target: | 5'-AUGUAACCAAGAGUAUUCCAU-3' | (SEQ ID NO: 1725) |
| TTR-653 | 21 nt Target: | 5'-UGUAACCAAGAGUAUUCCAUU-3' | (SEQ ID NO: 1726) |
| TTR-654 | 21 nt Target: | 5'-GUAACCAAGAGUAUUCCAUUU-3' | (SEQ ID NO: 1727) |
| TTR-655 | 21 nt Target: | 5'-UAACCAAGAGUAUUCCAUUUU-3' | (SEQ ID NO: 1728) |
| TTR-656 | 21 nt Target: | 5'-AACCAAGAGUAUUCCAUUUUU-3' | (SEQ ID NO: 1729) |
| TTR-657 | 21 nt Target: | 5'-ACCAAGAGUAUUCCAUUUUUA-3' | (SEQ ID NO: 1730) |
| TTR-658 | 21 nt Target: | 5'-CCAAGAGUAUUCCAUUUUUAC-3' | (SEQ ID NO: 1731) |
| TTR-659 | 21 nt Target: | 5'-CAAGAGUAUUCCAUUUUUACU-3' | (SEQ ID NO: 1732) |
| TTR-660 | 21 nt Target: | 5'-AAGAGUAUUCCAUUUUUACUA-3' | (SEQ ID NO: 1733) |
| TTR-661 | 21 nt Target: | 5'-AGAGUAUUCCAUUUUUACUAA-3' | (SEQ ID NO: 1734) |
| TTR-662 | 21 nt Target: | 5'-GAGUAUUCCAUUUUUACUAAA-3' | (SEQ ID NO: 1735) |
| TTR-663 | 21 nt Target: | 5'-AGUAUUCCAUUUUUACUAAAG-3' | (SEQ ID NO: 1736) |
| TTR-664 | 21 nt Target: | 5'-GUAUUCCAUUUUUACUAAAGC-3' | (SEQ ID NO: 1737) |
| TTR-665 | 21 nt Target: | 5'-UAUUCCAUUUUUACUAAAGCA-3' | (SEQ ID NO: 1738) |
| TTR-666 | 21 nt Target: | 5'-AUUCCAUUUUUACUAAAGCAG-3' | (SEQ ID NO: 1739) |
| TTR-667 | 21 nt Target: | 5'-UUCCAUUUUUACUAAAGCAGU-3' | (SEQ ID NO: 1740) |
| TTR-668 | 21 nt Target: | 5'-UCCAUUUUUACUAAAGCAGUG-3' | (SEQ ID NO: 1741) |
| TTR-669 | 21 nt Target: | 5'-CCAUUUUUACUAAAGCAGUGU-3' | (SEQ ID NO: 1742) |
| TTR-670 | 21 nt Target: | 5'-CAUUUUUACUAAAGCAGUGUU-3' | (SEQ ID NO: 1743) |
| TTR-671 | 21 nt Target: | 5'-AUUUUUACUAAAGCAGUGUUU-3' | (SEQ ID NO: 1744) |
| TTR-672 | 21 nt Target: | 5'-UUUUUACUAAAGCAGUGUUUU-3' | (SEQ ID NO: 1745) |
| TTR-673 | 21 nt Target: | 5'-UUUUACUAAAGCAGUGUUUUC-3' | (SEQ ID NO: 1746) |
| TTR-674 | 21 nt Target: | 5'-UUUACUAAAGCAGUGUUUUCA-3' | (SEQ ID NO: 1747) |
| TTR-675 | 21 nt Target: | 5'-UUACUAAAGCAGUGUUUCAC-3' | (SEQ ID NO: 1748) |

TABLE 4-continued

DsiRNA Target Sequences (21mers) in Transthyretin mRNA

| | |
|---|---|
| TTR-676 21 nt Target: 5'-UACUAAAGCAGUGUUUUCACC-3' | (SEQ ID NO: 1749) |
| TTR-677 21 nt Target: 5'-ACUAAAGCAGUGUUUUCACCU-3' | (SEQ ID NO: 1750) |
| TTR-678 21 nt Target: 5'-CUAAAGCAGUGUUUUCACCUC-3' | (SEQ ID NO: 1751) |
| TTR-679 21 nt Target: 5'-UAAAGCAGUGUUUUCACCUCA-3' | (SEQ ID NO: 1752) |
| TTR-680 21 nt Target: 5'-AAAGCAGUGUUUUCACCUCAU-3' | (SEQ ID NO: 1753) |
| TTR-681 21 nt Target: 5'-AAGCAGUGUUUUCACCUCAUA-3' | (SEQ ID NO: 1754) |
| TTR-682 21 nt Target: 5'-AGCAGUGUUUUCACCUCAUAU-3' | (SEQ ID NO: 1755) |
| TTR-683 21 nt Target: 5'-GCAGUGUUUUCACCUCAUAUG-3' | (SEQ ID NO: 1756) |
| TTR-684 21 nt Target: 5'-CAGUGUUUUCACCUCAUAUGC-3' | (SEQ ID NO: 1757) |
| TTR-685 21 nt Target: 5'-AGUGUUUUCACCUCAUAUGCU-3' | (SEQ ID NO: 1758) |
| TTR-686 21 nt Target: 5'-GUGUUUUCACCUCAUAUGCUA-3' | (SEQ ID NO: 1759) |
| TTR-687 21 nt Target: 5'-UGUUUUCACCUCAUAUGCUAU-3' | (SEQ ID NO: 1760) |
| TTR-688 21 nt Target: 5'-GUUUUCACCUCAUAUGCUAUG-3' | (SEQ ID NO: 1761) |
| TTR-689 21 nt Target: 5'-UUUUCACCUCAUAUGCUAUGU-3' | (SEQ ID NO: 1762) |
| TTR-690 21 nt Target: 5'-UUUCACCUCAUAUGCUAUGUU-3' | (SEQ ID NO: 1763) |
| TTR-691 21 nt Target: 5'-UUCACCUCAUAUGCUAUGUUA-3' | (SEQ ID NO: 1764) |
| TTR-692 21 nt Target: 5'-UCACCUCAUAUGCUAUGUUAG-3' | (SEQ ID NO: 1765) |
| TTR-693 21 nt Target: 5'-CACCUCAUAUGCUAUGUUAGA-3' | (SEQ ID NO: 1766) |
| TTR-694 21 nt Target: 5'-ACCUCAUAUGCUAUGUUAGAA-3' | (SEQ ID NO: 1767) |
| TTR-695 21 nt Target: 5'-CCUCAUAUGCUAUGUUAGAAG-3' | (SEQ ID NO: 1768) |
| TTR-696 21 nt Target: 5'-CUCAUAUGCUAUGUUAGAAGU-3' | (SEQ ID NO: 1769) |
| TTR-697 21 nt Target: 5'-UCAUAUGCUAUGUUAGAAGUC-3' | (SEQ ID NO: 1770) |
| TTR-698 21 nt Target: 5'-CAUAUGCUAUGUUAGAAGUCC-3' | (SEQ ID NO: 1771) |
| TTR-699 21 nt Target: 5'-AUAUGCUAUGUUAGAAGUCCA-3' | (SEQ ID NO: 1772) |
| TTR-702 21 nt Target: 5'-UGCUAUGUUAGAAGUCCAGGC-3' | (SEQ ID NO: 1773) |
| TTR-704 21 nt Target: 5'-CUAUGUUAGAAGUCCAGGCAG-3' | (SEQ ID NO: 1774) |
| TTR-705 21 nt Target: 5'-UAUGUUAGAAGUCCAGGCAGA-3' | (SEQ ID NO: 1775) |
| TTR-706 21 nt Target: 5'-AUGUUAGAAGUCCAGGCAGAG-3' | (SEQ ID NO: 1776) |
| TTR-707 21 nt Target: 5'-UGUUAGAAGUCCAGGCAGAGA-3' | (SEQ ID NO: 1777) |
| TTR-708 21 nt Target: 5'-GUUAGAAGUCCAGGCAGAGAC-3' | (SEQ ID NO: 1778) |
| TTR-709 21 nt Target: 5'-UUAGAAGUCCAGGCAGAGACA-3' | (SEQ ID NO: 1779) |
| TTR-710 21 nt Target: 5'-UAGAAGUCCAGGCAGAGACAA-3' | (SEQ ID NO: 1780) |
| TTR-711 21 nt Target: 5'-AGAAGUCCAGGCAGAGACAAU-3' | (SEQ ID NO: 1781) |
| TTR-712 21 nt Target: 5'-GAAGUCCAGGCAGAGACAAUA-3' | (SEQ ID NO: 1782) |
| TTR-713 21 nt Target: 5'-AAGUCCAGGCAGAGACAAUAA-3' | (SEQ ID NO: 1783) |
| TTR-714 21 nt Target: 5'-AGUCCAGGCAGAGACAAUAAA-3' | (SEQ ID NO: 1784) |
| TTR-716 21 nt Target: 5'-UCCAGGCAGAGACAAUAAAAC-3' | (SEQ ID NO: 1785) |
| TTR-717 21 nt Target: 5'-CCAGGCAGAGACAAUAAAACA-3' | (SEQ ID NO: 1786) |
| TTR-718 21 nt Target: 5'-CAGGCAGAGACAAUAAAACAU-3' | (SEQ ID NO: 1787) |

TABLE 4-continued

DsiRNA Target Sequences (21mers) in Transthyretin mRNA

| | | |
|---|---|---|
| TTR-719 21 nt Target: | 5'-AGGCAGAGACAAUAAAACAUU-3' | (SEQ ID NO: 1788) |
| TTR-720 21 nt Target: | 5'-GGCAGAGACAAUAAAACAUUC-3' | (SEQ ID NO: 1789) |
| TTR-721 21 nt Target: | 5'-GCAGAGACAAUAAAACAUUCC-3' | (SEQ ID NO: 1790) |
| TTR-722 21 nt Target: | 5'-CAGAGACAAUAAAACAUUCCU-3' | (SEQ ID NO: 1791) |
| TTR-723 21 nt Target: | 5'-AGAGACAAUAAAACAUUCCUG-3' | (SEQ ID NO: 1792) |
| TTR-724 21 nt Target: | 5'-GAGACAAUAAAACAUUCCUGU-3' | (SEQ ID NO: 1793) |
| TTR-725 21 nt Target: | 5'-AGACAAUAAAACAUUCCUGUG-3' | (SEQ ID NO: 1794) |
| TTR-726 21 nt Target: | 5'-GACAAUAAAACAUUCCUGUGA-3' | (SEQ ID NO: 1795) |
| TTR-727 21 nt Target: | 5'-ACAAUAAAACAUUCCUGUGAA-3' | (SEQ ID NO: 1796) |
| TTR-728 21 nt Target: | 5'-CAAUAAAACAUUCCUGUGAAA-3' | (SEQ ID NO: 1797) |
| TTR-731 21 nt Target: | 5'-UAAAACAUUCCUGUGAAAGGC-3' | (SEQ ID NO: 1798) |
| TTR-732 21 nt Target: | 5'-AAAACAUUCCUGUGAAAGGCA-3' | (SEQ ID NO: 1799) |
| TTR-733 21 nt Target: | 5'-AAACAUUCCUGUGAAAGGCAC-3' | (SEQ ID NO: 1800) |
| TTR-734 21 nt Target: | 5'-AACAUUCCUGUGAAAGGCACU-3' | (SEQ ID NO: 1801) |
| TTR-735 21 nt Target: | 5'-ACAUUCCUGUGAAAGGCACUU-3' | (SEQ ID NO: 1802) |
| TTR-736 21 nt Target: | 5'-CAUUCCUGUGAAAGGCACUUU-3' | (SEQ ID NO: 1803) |
| TTR-738 21 nt Target: | 5'-UUCCUGUGAAAGGCACUUUUC-3' | (SEQ ID NO: 1804) |
| TTR-739 21 nt Target: | 5'-UCCUGUGAAAGGCACUUUUCA-3' | (SEQ ID NO: 1805) |
| TTR-740 21 nt Target: | 5'-CCUGUGAAAGGCACUUUUCAU-3' | (SEQ ID NO: 1806) |
| TTR-741 21 nt Target: | 5'-CUGUGAAAGGCACUUUUCAUU-3' | (SEQ ID NO: 1807) |
| TTR-742 21 nt Target: | 5'-UGUGAAAGGCACUUUUCAUUC-3' | (SEQ ID NO: 1808) |
| TTR-743 21 nt Target: | 5'-GUGAAAGGCACUUUUCAUUCC-3' | (SEQ ID NO: 1809) |
| TTR-744 21 nt Target: | 5'-UGAAAGGCACUUUUCAUUCCA-3' | (SEQ ID NO: 1810) |
| TTR-745 21 nt Target: | 5'-GAAAGGCACUUUUCAUUCCAC-3' | (SEQ ID NO: 1811) |
| TTR-746 21 nt Target: | 5'-AAAGGCACUUUUCAUUCCACU-3' | (SEQ ID NO: 1812) |
| TTR-747 21 nt Target: | 5'-AAGGCACUUUUCAUUCCACUU-3' | (SEQ ID NO: 1813) |
| TTR-748 21 nt Target: | 5'-AGGCACUUUUCAUUCCACUUU-3' | (SEQ ID NO: 1814) |
| TTR-749 21 nt Target: | 5'-GGCACUUUUCAUUCCACUUUA-3' | (SEQ ID NO: 1815) |
| TTR-750 21 nt Target: | 5'-GCACUUUUCAUUCCACUUUAA-3' | (SEQ ID NO: 1816) |
| TTR-751 21 nt Target: | 5'-CACUUUUCAUUCCACUUUAAC-3' | (SEQ ID NO: 1817) |
| TTR-752 21 nt Target: | 5'-ACUUUUCAUUCCACUUUAACU-3' | (SEQ ID NO: 1818) |
| TTR-753 21 nt Target: | 5'-CUUUUCAUUCCACUUUAACUU-3' | (SEQ ID NO: 1819) |
| TTR-754 21 nt Target: | 5'-UUUUCAUUCCACUUUAACUUG-3' | (SEQ ID NO: 1820) |
| TTR-755 21 nt Target: | 5'-UUUCAUUCCACUUUAACUUGA-3' | (SEQ ID NO: 1821) |
| TTR-756 21 nt Target: | 5'-UUCAUUCCACUUUAACUUGAU-3' | (SEQ ID NO: 1822) |
| TTR-757 21 nt Target: | 5'-UCAUUCCACUUUAACUUGAUU-3' | (SEQ ID NO: 1823) |
| TTR-758 21 nt Target: | 5'-CAUUCCACUUUAACUUGAUUU-3' | (SEQ ID NO: 1824) |
| TTR-759 21 nt Target: | 5'-AUUCCACUUUAACUUGAUUUU-3' | (SEQ ID NO: 1825) |
| TTR-760 21 nt Target: | 5'-UUCCACUUUAACUUGAUUUUU-3' | (SEQ ID NO: 1826) |

TABLE 4-continued

DsiRNA Target Sequences (21mers) in Transthyretin mRNA

| | | |
|---|---|---|
| TTR-761 21 nt Target: | 5'-UCCACUUUAACUUGAUUUUUU-3' | (SEQ ID NO: 1827) |
| TTR-762 21 nt Target: | 5'-CCACUUUAACUUGAUUUUUUA-3' | (SEQ ID NO: 1828) |
| TTR-763 21 nt Target: | 5'-CACUUUAACUUGAUUUUUUAA-3' | (SEQ ID NO: 1829) |
| TTR-764 21 nt Target: | 5'-ACUUUAACUUGAUUUUUUAAA-3' | (SEQ ID NO: 1830) |
| TTR-765 21 nt Target: | 5'-CUUUAACUUGAUUUUUUAAAU-3' | (SEQ ID NO: 1831) |
| TTR-766 21 nt Target: | 5'-UUUAACUUGAUUUUUUAAAUU-3' | (SEQ ID NO: 1832) |
| TTR-767 21 nt Target: | 5'-UUAACUUGAUUUUUUAAAUUC-3' | (SEQ ID NO: 1833) |
| TTR-768 21 nt Target: | 5'-UAACUUGAUUUUUUAAAUUCC-3' | (SEQ ID NO: 1834) |
| TTR-769 21 nt Target: | 5'-AACUUGAUUUUUUAAAUUCCC-3' | (SEQ ID NO: 1835) |
| TTR-770 21 nt Target: | 5'-ACUUGAUUUUUUAAAUUCCCU-3' | (SEQ ID NO: 1836) |
| TTR-771 21 nt Target: | 5'-CUUGAUUUUUUAAAUUCCCUU-3' | (SEQ ID NO: 1837) |
| TTR-772 21 nt Target: | 5'-UUGAUUUUUUAAAUUCCCUUA-3' | (SEQ ID NO: 1838) |
| TTR-773 21 nt Target: | 5'-UGAUUUUUUAAAUUCCCUUAU-3' | (SEQ ID NO: 1839) |
| TTR-775 21 nt Target: | 5'-AUUUUUUAAAUUCCCUUAUUG-3' | (SEQ ID NO: 1840) |
| TTR-780 21 nt Target: | 5'-UUAAAUUCCCUUAUUGUCCCU-3' | (SEQ ID NO: 1841) |
| TTR-781 21 nt Target: | 5'-UAAAUUCCCUUAUUGUCCCUU-3' | (SEQ ID NO: 1842) |
| TTR-784 21 nt Target: | 5'-AUUCCCUUAUUGUCCCUUCCA-3' | (SEQ ID NO: 1843) |
| TTR-805 21 nt Target: | 5'-AAAAAAAGAGAAUCAAAAUUU-3' | (SEQ ID NO: 1844) |
| TTR-806 21 nt Target: | 5'-AAAAAAGAGAAUCAAAAUUUU-3' | (SEQ ID NO: 1845) |
| TTR-807 21 nt Target: | 5'-AAAAAGAGAAUCAAAAUUUUA-3' | (SEQ ID NO: 1846) |
| TTR-808 21 nt Target: | 5'-AAAAGAGAAUCAAAAUUUUAC-3' | (SEQ ID NO: 1847) |
| TTR-809 21 nt Target: | 5'-AAAGAGAAUCAAAAUUUUACA-3' | (SEQ ID NO: 1848) |
| TTR-810 21 nt Target: | 5'-AAGAGAAUCAAAAUUUUACAA-3' | (SEQ ID NO: 1849) |
| TTR-811 21 nt Target: | 5'-AGAGAAUCAAAAUUUUACAAA-3' | (SEQ ID NO: 1850) |
| TTR-812 21 nt Target: | 5'-GAGAAUCAAAAUUUUACAAAG-3' | (SEQ ID NO: 1851) |
| TTR-813 21 nt Target: | 5'-AGAAUCAAAAUUUUACAAAGA-3' | (SEQ ID NO: 1852) |
| TTR-814 21 nt Target: | 5'-GAAUCAAAAUUUUACAAAGAA-3' | (SEQ ID NO: 1853) |
| TTR-815 21 nt Target: | 5'-AAUCAAAAUUUUACAAAGAAU-3' | (SEQ ID NO: 1854) |
| TTR-816 21 nt Target: | 5'-AUCAAAAUUUUACAAAGAAUC-3' | (SEQ ID NO: 1855) |
| TTR-817 21 nt Target: | 5'-UCAAAAUUUUACAAAGAAUCA-3' | (SEQ ID NO: 1856) |
| TTR-818 21 nt Target: | 5'-CAAAAUUUUACAAAGAAUCAA-3' | (SEQ ID NO: 1857) |
| TTR-819 21 nt Target: | 5'-AAAAUUUUACAAAGAAUCAAA-3' | (SEQ ID NO: 1858) |
| TTR-821 21 nt Target: | 5'-AAUUUUACAAAGAAUCAAAGG-3' | (SEQ ID NO: 1859) |
| TTR-822 21 nt Target: | 5'-AUUUUACAAAGAAUCAAAGGA-3' | (SEQ ID NO: 1860) |
| TTR-823 21 nt Target: | 5'-UUUUACAAAGAAUCAAAGGAA-3' | (SEQ ID NO: 1861) |
| TTR-824 21 nt Target: | 5'-UUUACAAAGAAUCAAAGGAAU-3' | (SEQ ID NO: 1862) |
| TTR-825 21 nt Target: | 5'-UUACAAAGAAUCAAAGGAAUU-3' | (SEQ ID NO: 1863) |
| TTR-826 21 nt Target: | 5'-UACAAAGAAUCAAAGGAAUUC-3' | (SEQ ID NO: 1864) |
| TTR-827 21 nt Target: | 5'-ACAAAGAAUCAAAGGAAUUCU-3' | (SEQ ID NO: 1865) |

TABLE 4-continued

DsiRNA Target Sequences (21mers) in Transthyretin mRNA

| | | |
|---|---|---|
| TTR-828 21 nt Target: | 5'-CAAAGAAUCAAAGGAAUUCUA-3' | (SEQ ID NO: 1866) |
| TTR-829 21 nt Target: | 5'-AAAGAAUCAAAGGAAUUCUAG-3' | (SEQ ID NO: 1867) |
| TTR-830 21 nt Target: | 5'-AAGAAUCAAAGGAAUUCUAGA-3' | (SEQ ID NO: 1868) |
| TTR-831 21 nt Target: | 5'-AGAAUCAAAGGAAUUCUAGAA-3' | (SEQ ID NO: 1869) |
| TTR-832 21 nt Target: | 5'-GAAUCAAAGGAAUUCUAGAAA-3' | (SEQ ID NO: 1870) |
| TTR-833 21 nt Target: | 5'-AAUCAAAGGAAUUCUAGAAAG-3' | (SEQ ID NO: 1871) |
| TTR-834 21 nt Target: | 5'-AUCAAAGGAAUUCUAGAAAGU-3' | (SEQ ID NO: 1872) |
| TTR-835 21 nt Target: | 5'-UCAAAGGAAUUCUAGAAAGUA-3' | (SEQ ID NO: 1873) |
| TTR-869 21 nt Target: | 5'-CUAGGAGAGAUCCAAAUUUCC-3' | (SEQ ID NO: 1874) |
| TTR-870 21 nt Target: | 5'-UAGGAGAGAUCCAAAUUUCCA-3' | (SEQ ID NO: 1875) |
| TTR-873 21 nt Target: | 5'-GAGAGAUCCAAAUUUCCAUUG-3' | (SEQ ID NO: 1876) |
| TTR-874 21 nt Target: | 5'-AGAGAUCCAAAUUUCCAUUGU-3' | (SEQ ID NO: 1877) |
| TTR-875 21 nt Target: | 5'-GAGAUCCAAAUUUCCAUUGUC-3' | (SEQ ID NO: 1878) |
| TTR-876 21 nt Target: | 5'-AGAUCCAAAUUUCCAUUGUCU-3' | (SEQ ID NO: 1879) |
| TTR-877 21 nt Target: | 5'-GAUCCAAAUUUCCAUUGUCUU-3' | (SEQ ID NO: 1880) |
| TTR-878 21 nt Target: | 5'-AUCCAAAUUUCCAUUGUCUUG-3' | (SEQ ID NO: 1881) |
| TTR-879 21 nt Target: | 5'-UCCAAAUUUCCAUUGUCUUGC-3' | (SEQ ID NO: 1882) |
| TTR-880 21 nt Target: | 5'-CCAAAUUUCCAUUGUCUUGCA-3' | (SEQ ID NO: 1883) |
| TTR-881 21 nt Target: | 5'-CAAAUUUCCAUUGUCUUGCAA-3' | (SEQ ID NO: 1884) |
| TTR-882 21 nt Target: | 5'-AAAUUUCCAUUGUCUUGCAAG-3' | (SEQ ID NO: 1885) |
| TTR-883 21 nt Target: | 5'-AAUUUCCAUUGUCUUGCAAGC-3' | (SEQ ID NO: 1886) |
| TTR-884 21 nt Target: | 5'-AUUUCCAUUGUCUUGCAAGCA-3' | (SEQ ID NO: 1887) |
| TTR-885 21 nt Target: | 5'-UUUCCAUUGUCUUGCAAGCAA-3' | (SEQ ID NO: 1888) |
| TTR-886 21 nt Target: | 5'-UUCCAUUGUCUUGCAAGCAAA-3' | (SEQ ID NO: 1889) |
| TTR-887 21 nt Target: | 5'-UCCAUUGUCUUGCAAGCAAAG-3' | (SEQ ID NO: 1890) |
| TTR-888 21 nt Target: | 5'-CCAUUGUCUUGCAAGCAAAGC-3' | (SEQ ID NO: 1891) |
| TTR-889 21 nt Target: | 5'-CAUUGUCUUGCAAGCAAAGCA-3' | (SEQ ID NO: 1892) |
| TTR-890 21 nt Target: | 5'-AUUGUCUUGCAAGCAAAGCAC-3' | (SEQ ID NO: 1893) |
| TTR-891 21 nt Target: | 5'-UUGUCUUGCAAGCAAAGCACG-3' | (SEQ ID NO: 1894) |
| TTR-892 21 nt Target: | 5'-UGUCUUGCAAGCAAAGCACGU-3' | (SEQ ID NO: 1895) |
| TTR-893 21 nt Target: | 5'-GUCUUGCAAGCAAAGCACGUA-3' | (SEQ ID NO: 1896) |
| TTR-894 21 nt Target: | 5'-UCUUGCAAGCAAAGCACGUAU-3' | (SEQ ID NO: 1897) |
| TTR-895 21 nt Target: | 5'-CUUGCAAGCAAAGCACGUAUU-3' | (SEQ ID NO: 1898) |
| TTR-896 21 nt Target: | 5'-UUGCAAGCAAAGCACGUAUUA-3' | (SEQ ID NO: 1899) |
| TTR-897 21 nt Target: | 5'-UGCAAGCAAAGCACGUAUUAA-3' | (SEQ ID NO: 1900) |
| TTR-898 21 nt Target: | 5'-GCAAGCAAAGCACGUAUUAAA-3' | (SEQ ID NO: 1901) |
| TTR-899 21 nt Target: | 5'-CAAGCAAAGCACGUAUUAAAU-3' | (SEQ ID NO: 1902) |
| TTR-900 21 nt Target: | 5'-AAGCAAAGCACGUAUUAAAUA-3' | (SEQ ID NO: 1903) |
| TTR-901 21 nt Target: | 5'-AGCAAAGCACGUAUUAAAUAU-3' | (SEQ ID NO: 1904) |

TABLE 4-continued

DsiRNA Target Sequences (21mers) in Transthyretin mRNA

TTR-902 21 nt Target: 5'-GCAAAGCACGUAUUAAAUAUG-3' (SEQ ID NO: 1905)

TTR-903 21 nt Target: 5'-CAAAGCACGUAUUAAAUAUGA-3' (SEQ ID NO: 1906)

TTR-904 21 nt Target: 5'-AAAGCACGUAUUAAAUAUGAU-3' (SEQ ID NO: 1907)

TTR-905 21 nt Target: 5'-AAGCACGUAUUAAAUAUGAUC-3' (SEQ ID NO: 1908)

TTR-906 21 nt Target: 5'-AGCACGUAUUAAAUAUGAUCU-3' (SEQ ID NO: 1909)

TTR-908 21 nt Target: 5'-CACGUAUUAAAUAUGAUCUGC-3' (SEQ ID NO: 1910)

TTR-909 21 nt Target: 5'-ACGUAUUAAAUAUGAUCUGCA-3' (SEQ ID NO: 1911)

TTR-911 21 nt Target: 5'-GUAUUAAAUAUGAUCUGCAGC-3' (SEQ ID NO: 1912)

TTR-912 21 nt Target: 5'-UAUUAAAUAUGAUCUGCAGCC-3' (SEQ ID NO: 1913)

TTR-913 21 nt Target: 5'-AUUAAAUAUGAUCUGCAGCCA-3' (SEQ ID NO: 1914)

TTR-914 21 nt Target: 5'-UUAAAUAUGAUCUGCAGCCAU-3' (SEQ ID NO: 1915)

TTR-915 21 nt Target: 5'-UAAAUAUGAUCUGCAGCCAUU-3' (SEQ ID NO: 1916)

TTR-916 21 nt Target: 5'-AAAUAUGAUCUGCAGCCAUUA-3' (SEQ ID NO: 1917)

TTR-917 21 nt Target: 5'-AAUAUGAUCUGCAGCCAUUAA-3' (SEQ ID NO: 1918)

TTR-918 21 nt Target: 5'-AUAUGAUCUGCAGCCAUUAAA-3' (SEQ ID NO: 1919)

TTR-919 21 nt Target: 5'-UAUGAUCUGCAGCCAUUAAAA-3' (SEQ ID NO: 1920)

TABLE 5

Selected Human Anti-Transthyretin "Blunt/Blunt" DsiRNAs

| | | |
|---|---|---|
| TTR-27 Target: | 5'-GUUGACUAAGUCAAUAAUCAGAAUCAG-3'<br>3'-CAACUGAUUCAGUUAUUAGUCUUAGUC-5'<br>5'-GTTGACTAAGTCAATAATCAGAATCAG-3' | (SEQ ID NO: 1921)<br>(SEQ ID NO: 385)<br>(SEQ ID NO: 769) |
| TTR-28 Target: | 5'-UUGACUAAGUCAAUAAUCAGAAUCAGC-3'<br>3'-AACUGAUUCAGUUAUUAGUCUUAGUCG-5'<br>5'-TTGACTAAGTCAATAATCAGAATCAGC-3' | (SEQ ID NO: 1922)<br>(SEQ ID NO: 386)<br>(SEQ ID NO: 770) |
| TTR-29 Target: | 5'-UGACUAAGUCAAUAAUCAGAAUCAGCA-3'<br>3'-ACUGAUUCAGUUAUUAGUCUUAGUCGU-5'<br>5'-TGACTAAGTCAATAATCAGAATCAGCA-3' | (SEQ ID NO: 1923)<br>(SEQ ID NO: 387)<br>(SEQ ID NO: 771) |
| TTR-30 Target: | 5'-GACUAAGUCAAUAAUCAGAAUCAGCAG-3'<br>3'-CUGAUUCAGUUAUUAGUCUUAGUCGUC-5'<br>5'-GACTAAGTCAATAATCAGAATCAGCAG-3' | (SEQ ID NO: 1924)<br>(SEQ ID NO: 388)<br>(SEQ ID NO: 772) |
| TTR-31 Target: | 5'-ACUAAGUCAAUAAUCAGAAUCAGCAGG-3'<br>3'-UGAUUCAGUUAUUAGUCUUAGUCGUCC-5'<br>5'-ACTAAGTCAATAATCAGAATCAGCAGG-3' | (SEQ ID NO: 1925)<br>(SEQ ID NO: 389)<br>(SEQ ID NO: 773) |
| TTR-32 Target: | 5'-CUAAGUCAAUAAUCAGAAUCAGCAGGU-3'<br>3'-GAUUCAGUUAUUAGUCUUAGUCGUCCA-5'<br>5'-CTAAGTCAATAATCAGAATCAGCAGGT-3' | (SEQ ID NO: 1926)<br>(SEQ ID NO: 390)<br>(SEQ ID NO: 774) |
| TTR-33 Target: | 5'-UAAGUCAAUAAUCAGAAUCAGCAGGUU-3'<br>3'-AUUCAGUUAUUAGUCUUAGUCGUCCAA-5'<br>5'-TAAGTCAATAATCAGAATCAGCAGGTT-3' | (SEQ ID NO: 1927)<br>(SEQ ID NO: 391)<br>(SEQ ID NO: 775) |
| TTR-34 Target: | 5'-AAGUCAAUAAUCAGAAUCAGCAGGUUU-3'<br>3'-UUCAGUUAUUAGUCUUAGUCGUCCAAA-5'<br>5'-AAGTCAATAATCAGAATCAGCAGGTTT-3' | (SEQ ID NO: 1928)<br>(SEQ ID NO: 392)<br>(SEQ ID NO: 776) |
| TTR-35 Target: | 5'-AGUCAAUAAUCAGAAUCAGCAGGUUUG-3'<br>3'-UCAGUUAUUAGUCUUAGUCGUCCAAAC-5'<br>5'-AGTCAATAATCAGAATCAGCAGGTTTG-3' | (SEQ ID NO: 1929)<br>(SEQ ID NO: 393)<br>(SEQ ID NO: 777) |
| TTR-36 Target: | 5'-GUCAAUAAUCAGAAUCAGCAGGUUUGC-3'<br>3'-CAGUUAUUAGUCUUAGUCGUCCAAACG-5'<br>5'-GTCAATAATCAGAATCAGCAGGTTTGC-3' | (SEQ ID NO: 1930)<br>(SEQ ID NO: 394)<br>(SEQ ID NO: 778) |

TABLE 5-continued

Selected Human Anti-Transthyretin "Blunt/Blunt" DsiRNAs

|  | | |
|---|---|---|
| TTR-37 Target: | 5'-UCAAUAAUCAGAAUCAGCAGGUUUGCA-3'<br>3'-AGUUAUUAGUCUUAGUCGUCCAAACGU-5'<br>5'-TCAATAATCAGAATCAGCAGGTTTGCA-3' | (SEQ ID NO: 1931)<br>(SEQ ID NO: 395)<br>(SEQ ID NO: 779) |
| TTR-38 Target: | 5'-CAAUAAUCAGAAUCAGCAGGUUUGCAG-3'<br>3'-GUUAUUAGUCUUAGUCGUCCAAACGUC-5'<br>5'-CAATAATCAGAATCAGCAGGTTTGCAG-3' | (SEQ ID NO: 1932)<br>(SEQ ID NO: 396)<br>(SEQ ID NO: 780) |
| TTR-39 Target: | 5'-AAUAAUCAGAAUCAGCAGGUUUGCAGU-3'<br>3'-UUAUUAGUCUUAGUCGUCCAAACGUCA-5'<br>5'-AATAATCAGAATCAGCAGGTTTGCAGT-3' | (SEQ ID NO: 1933)<br>(SEQ ID NO: 397)<br>(SEQ ID NO: 781) |
| TTR-40 Target: | 5'-AUAAUCAGAAUCAGCAGGUUUGCAGUC-3'<br>3'-UAUUAGUCUUAGUCGUCCAAACGUCAG-5'<br>5'-ATAATCAGAATCAGCAGGTTTGCAGTC-3' | (SEQ ID NO: 1934)<br>(SEQ ID NO: 398)<br>(SEQ ID NO: 782) |
| TTR-41 Target: | 5'-UAAUCAGAAUCAGCAGGUUUGCAGUCA-3'<br>3'-AUUAGUCUUAGUCGUCCAAACGUCAGU-5'<br>5'-TAATCAGAATCAGCAGGTTTGCAGTCA-3' | (SEQ ID NO: 1935)<br>(SEQ ID NO: 399)<br>(SEQ ID NO: 783) |
| TTR-43 Target: | 5'-AUCAGAAUCAGCAGGUUUGCAGUCAGA-3'<br>3'-UAGUCUUAGUCGUCCAAACGUCAGUCU-5'<br>5'-ATCAGAATCAGCAGGTTTGCAGTCAGA-3' | (SEQ ID NO: 1936)<br>(SEQ ID NO: 400)<br>(SEQ ID NO: 784) |
| TTR-44 Target: | 5'-UCAGAAUCAGCAGGUUUGCAGUCAGAU-3'<br>3'-AGUCUUAGUCGUCCAAACGUCAGUCUA-5'<br>5'-TCAGAATCAGCAGGTTTGCAGTCAGAT-3' | (SEQ ID NO: 1937)<br>(SEQ ID NO: 401)<br>(SEQ ID NO: 785) |
| TTR-46 Target: | 5'-AGAAUCAGCAGGUUUGCAGUCAGAUUG-3'<br>3'-UCUUAGUCGUCCAAACGUCAGUCUAAC-5'<br>5'-AGAATCAGCAGGTTTGCAGTCAGATTG-3' | (SEQ ID NO: 1938)<br>(SEQ ID NO: 402)<br>(SEQ ID NO: 786) |
| TTR-47 Target: | 5'-GAAUCAGCAGGUUUGCAGUCAGAUUGG-3'<br>3'-CUUAGUCGUCCAAACGUCAGUCUAACC-5'<br>5'-GAATCAGCAGGTTTGCAGTCAGATTGG-3' | (SEQ ID NO: 1939)<br>(SEQ ID NO: 403)<br>(SEQ ID NO: 787) |
| TTR-59 Target: | 5'-UUGCAGUCAGAUUGGCAGGGAUAAGCA-3'<br>3'-AACGUCAGUCUAACCGUCCCUAUUCGU-5'<br>5'-TTGCAGTCAGATTGGCAGGGATAAGCA-3' | (SEQ ID NO: 1940)<br>(SEQ ID NO: 404)<br>(SEQ ID NO: 788) |
| TTR-84 Target: | 5'-CAGCCUAGCUCAGGAGAAGUGAGUAUA-3'<br>3'-GUCGGAUCGAGUCCUCUUCACUCAUAU-5'<br>5'-CAGCCTAGCTCAGGAGAAGTGAGTATA-3' | (SEQ ID NO: 1941)<br>(SEQ ID NO: 405)<br>(SEQ ID NO: 789) |
| TTR-87 Target: | 5'-CCUAGCUCAGGAGAAGUGAGUAUAAAA-3'<br>3'-GGAUCGAGUCCUCUUCACUCAUAUUUU-5'<br>5'-CCTAGCTCAGGAGAAGTGAGTATAAAA-3' | (SEQ ID NO: 1942)<br>(SEQ ID NO: 406)<br>(SEQ ID NO: 790) |
| TTR-88 Target: | 5'-CUAGCUCAGGAGAAGUGAGUAUAAAAG-3'<br>3'-GAUCGAGUCCUCUUCACUCAUAUUUUC-5'<br>5'-CTAGCTCAGGAGAAGTGAGTATAAAAG-3' | (SEQ ID NO: 1943)<br>(SEQ ID NO: 407)<br>(SEQ ID NO: 791) |
| TTR-89 Target: | 5'-UAGCUCAGGAGAAGUGAGUAUAAAAGC-3'<br>3'-AUCGAGUCCUCUUCACUCAUAUUUUCG-5'<br>5'-TAGCTCAGGAGAAGTGAGTATAAAAGC-3' | (SEQ ID NO: 1944)<br>(SEQ ID NO: 408)<br>(SEQ ID NO: 792) |
| TTR-90 Target: | 5'-AGCUCAGGAGAAGUGAGUAUAAAAGCC-3'<br>3'-UCGAGUCCUCUUCACUCAUAUUUUCGG-5'<br>5'-AGCTCAGGAGAAGTGAGTATAAAAGCC-3' | (SEQ ID NO: 1945)<br>(SEQ ID NO: 409)<br>(SEQ ID NO: 793) |
| TTR-92 Target: | 5'-CUCAGGAGAAGUGAGUAUAAAAGCCCC-3'<br>3'-GAGUCCUCUUCACUCAUAUUUUCGGGG-5'<br>5'-CTCAGGAGAAGTGAGTATAAAAGCCCC-3' | (SEQ ID NO: 1946)<br>(SEQ ID NO: 410)<br>(SEQ ID NO: 794) |
| TTR-126 Target: | 5'-GAGCAGCCAUCACAGAAGUCCACUCAU-3'<br>3'-CUCGUCGGUAGUGUCUUCAGGUGAGUA-5'<br>5'-GAGCAGCCATCACAGAAGTCCACTCAT-3' | (SEQ ID NO: 1947)<br>(SEQ ID NO: 411)<br>(SEQ ID NO: 795) |
| TTR-127 Target: | 5'-AGCAGCCAUCACAGAAGUCCACUCAUU-3'<br>3'-UCGUCGGUAGUGUCUUCAGGUGAGUAA-5'<br>5'-AGCAGCCATCACAGAAGTCCACTCATT-3' | (SEQ ID NO: 1948)<br>(SEQ ID NO: 412)<br>(SEQ ID NO: 796) |
| TTR-128 Target: | 5'-GCAGCCAUCACAGAAGUCCACUCAUUC-3'<br>3'-CGUCGGUAGUGUCUUCAGGUGAGUAAG-5'<br>5'-GCAGCCATCACAGAAGTCCACTCATTC-3' | (SEQ ID NO: 1949)<br>(SEQ ID NO: 413)<br>(SEQ ID NO: 797) |

TABLE 5-continued

Selected Human Anti-Transthyretin "Blunt/Blunt" DsiRNAs

| | | |
|---|---|---|
| TTR-129 Target: | 5'-CAGCCAUCACAGAAGUCCACUCAUUCU-3'<br>3'-GUCGGUAGUGUCUUCAGGUGAGUAAGA-5'<br>5'-CAGCCATCACAGAAGTCCACTCATTCT-3' | (SEQ ID NO: 1950)<br>(SEQ ID NO: 414)<br>(SEQ ID NO: 798) |
| TTR-130 Target: | 5'-AGCCAUCACAGAAGUCCACUCAUUCUU-3'<br>3'-UCGGUAGUGUCUUCAGGUGAGUAAGAA-5'<br>5'-AGCCATCACAGAAGTCCACTCATTCTT-3' | (SEQ ID NO: 1951)<br>(SEQ ID NO: 415)<br>(SEQ ID NO: 799) |
| TTR-131 Target: | 5'-GCCAUCACAGAAGUCCACUCAUUCUUG-3'<br>3'-CGGUAGUGUCUUCAGGUGAGUAAGAAC-5'<br>5'-GCCATCACAGAAGTCCACTCATTCTTG-3' | (SEQ ID NO: 1952)<br>(SEQ ID NO: 416)<br>(SEQ ID NO: 800) |
| TTR-132 Target: | 5'-CCAUCACAGAAGUCCACUCAUUCUUGG-3'<br>3'-GGUAGUGUCUUCAGGUGAGUAAGAACC-5'<br>5'-CCATCACAGAAGTCCACTCATTCTTGG-3' | (SEQ ID NO: 1953)<br>(SEQ ID NO: 417)<br>(SEQ ID NO: 801) |
| TTR-134 Target: | 5'-AUCACAGAAGUCCACUCAUUCUUGGCA-3'<br>3'-UAGUGUCUUCAGGUGAGUAAGAACCGU-5'<br>5'-ATCACAGAAGTCCACTCATTCTTGGCA-3' | (SEQ ID NO: 1954)<br>(SEQ ID NO: 418)<br>(SEQ ID NO: 802) |
| TTR-135 Target: | 5'-UCACAGAAGUCCACUCAUUCUUGGCAG-3'<br>3'-AGUGUCUUCAGGUGAGUAAGAACCGUC-5'<br>5'-TCACAGAAGTCCACTCATTCTTGGCAG-3' | (SEQ ID NO: 1955)<br>(SEQ ID NO: 419)<br>(SEQ ID NO: 803) |
| TTR-150 Target: | 5'-CAUUCUUGGCAGGAUGGCUUCUCAUCG-3'<br>3'-GUAAGAACCGUCCUACCGAAGAGUAGC-5'<br>5'-CATTCTTGGCAGGATGGCTTCTCATCG-3' | (SEQ ID NO: 1956)<br>(SEQ ID NO: 420)<br>(SEQ ID NO: 804) |
| TTR-151 Target: | 5'-AUUCUUGGCAGGAUGGCUUCUCAUCGU-3'<br>3'-UAAGAACCGUCCUACCGAAGAGUAGCA-5'<br>5'-ATTCTTGGCAGGATGGCTTCTCATCGT-3' | (SEQ ID NO: 1957)<br>(SEQ ID NO: 421)<br>(SEQ ID NO: 805) |
| TTR-152 Target: | 5'-UUCUUGGCAGGAUGGCUUCUCAUCGUC-3'<br>3'-AAGAACCGUCCUACCGAAGAGUAGCAG-5'<br>5'-TTCTTGGCAGGATGGCTTCTCATCGTC-3' | (SEQ ID NO: 1958)<br>(SEQ ID NO: 422)<br>(SEQ ID NO: 806) |
| TTR-153 Target: | 5'-UCUUGGCAGGAUGGCUUCUCAUCGUCU-3'<br>3'-AGAACCGUCCUACCGAAGAGUAGCAGA-5'<br>5'-TCTTGGCAGGATGGCTTCTCATCGTCT-3' | (SEQ ID NO: 1959)<br>(SEQ ID NO: 423)<br>(SEQ ID NO: 807) |
| TTR-154 Target: | 5'-CUUGGCAGGAUGGCUUCUCAUCGUCUG-3'<br>3'-GAACCGUCCUACCGAAGAGUAGCAGAC-5'<br>5'-CTTGGCAGGATGGCTTCTCATCGTCTG-3' | (SEQ ID NO: 1960)<br>(SEQ ID NO: 424)<br>(SEQ ID NO: 808) |
| TTR-155 Target: | 5'-UUGGCAGGAUGGCUUCUCAUCGUCUGC-3'<br>3'-AACCGUCCUACCGAAGAGUAGCAGACG-5'<br>5'-TTGGCAGGATGGCTTCTCATCGTCTGC-3' | (SEQ ID NO: 1961)<br>(SEQ ID NO: 425)<br>(SEQ ID NO: 809) |
| TTR-156 Target: | 5'-UGGCAGGAUGGCUUCUCAUCGUCUGCU-3'<br>3'-ACCGUCCUACCGAAGAGUAGCAGACGA-5'<br>5'-TGGCAGGATGGCTTCTCATCGTCTGCT-3' | (SEQ ID NO: 1962)<br>(SEQ ID NO: 426)<br>(SEQ ID NO: 810) |
| TTR-157 Target: | 5'-GGCAGGAUGGCUUCUCAUCGUCUGCUC-3'<br>3'-CCGUCCUACCGAAGAGUAGCAGACGAG-5'<br>5'-GGCAGGATGGCTTCTCATCGTCTGCTC-3' | (SEQ ID NO: 1963)<br>(SEQ ID NO: 427)<br>(SEQ ID NO: 811) |
| TTR-158 Target: | 5'-GCAGGAUGGCUUCUCAUCGUCUGCUCC-3'<br>3'-CGUCCUACCGAAGAGUAGCAGACGAGG-5'<br>5'-GCAGGATGGCTTCTCATCGTCTGCTCC-3' | (SEQ ID NO: 1964)<br>(SEQ ID NO: 428)<br>(SEQ ID NO: 812) |
| TTR-159 Target: | 5'-CAGGAUGGCUUCUCAUCGUCUGCUCCU-3'<br>3'-GUCCUACCGAAGAGUAGCAGACGAGGA-5'<br>5'-CAGGATGGCTTCTCATCGTCTGCTCCT-3' | (SEQ ID NO: 1965)<br>(SEQ ID NO: 429)<br>(SEQ ID NO: 813) |
| TTR-160 Target: | 5'-AGGAUGGCUUCUCAUCGUCUGCUCCUC-3'<br>3'-UCCUACCGAAGAGUAGCAGACGAGGAG-5'<br>5'-AGGATGGCTTCTCATCGTCTGCTCCTC-3' | (SEQ ID NO: 1966)<br>(SEQ ID NO: 430)<br>(SEQ ID NO: 814) |
| TTR-161 Target: | 5'-GGAUGGCUUCUCAUCGUCUGCUCCUCC-3'<br>3'-CCUACCGAAGAGUAGCAGACGAGGAGG-5'<br>5'-GGATGGCTTCTCATCGTCTGCTCCTCC-3' | (SEQ ID NO: 1967)<br>(SEQ ID NO: 431)<br>(SEQ ID NO: 815) |
| TTR-162 Target: | 5'-GAUGGCUUCUCAUCGUCUGCUCCUCCU-3'<br>3'-CUACCGAAGAGUAGCAGACGAGGAGGA-5'<br>5'-GATGGCTTCTCATCGTCTGCTCCTCCT-3' | (SEQ ID NO: 1968)<br>(SEQ ID NO: 432)<br>(SEQ ID NO: 816) |

TABLE 5-continued

Selected Human Anti-Transthyretin "Blunt/Blunt" DsiRNAs

|  |  |  |  |
|---|---|---|---|
| TTR-163 | 5'-AUGGCUUCUCAUCGUCUGCUCCUCCUC-3'<br>3'-UACCGAAGAGUAGCAGACGAGGAGGAG-5'<br>Target: 5'-ATGGCTTCTCATCGTCTGCTCCTCCTC-3' | (SEQ ID NO: 1969)<br>(SEQ ID NO: 433)<br>(SEQ ID NO: 817) | |
| TTR-164 | 5'-UGGCUUCUCAUCGUCUGCUCCUCCUCU-3'<br>3'-ACCGAAGAGUAGCAGACGAGGAGGAGA-5'<br>Target: 5'-TGGCTTCTCATCGTCTGCTCCTCCTCT-3' | (SEQ ID NO: 1970)<br>(SEQ ID NO: 434)<br>(SEQ ID NO: 818) | |
| TTR-165 | 5'-GGCUUCUCAUCGUCUGCUCCUCCUCUG-3'<br>3'-CCGAAGAGUAGCAGACGAGGAGGAGAC-5'<br>Target: 5'-GGCTTCTCATCGTCTGCTCCTCCTCTG-3' | (SEQ ID NO: 1971)<br>(SEQ ID NO: 435)<br>(SEQ ID NO: 819) | |
| TTR-186 | 5'-CCUCUGCCUUGCUGGACUGGUAUUUGU-3'<br>3'-GGAGACGGAACGACCUGACCAUAAACA-5'<br>Target: 5'-CCTCTGCCTTGCTGGACTGGTATTTGT-3' | (SEQ ID NO: 1972)<br>(SEQ ID NO: 436)<br>(SEQ ID NO: 820) | |
| TTR-187 | 5'-CUCUGCCUUGCUGGACUGGUAUUUGUG-3'<br>3'-GAGACGGAACGACCUGACCAUAAACAC-5'<br>Target: 5'-CTCTGCCTTGCTGGACTGGTATTTGTG-3' | (SEQ ID NO: 1973)<br>(SEQ ID NO: 437)<br>(SEQ ID NO: 821) | |
| TTR-234 | 5'-CACCGGUGAAUCCAAGUGUCCUCUGAU-3'<br>3'-GUGGCCACUUAGGUUCACAGGAGACUA-5'<br>Target: 5'-CACCGGTGAATCCAAGTGTCCTCTGAT-3' | (SEQ ID NO: 1974)<br>(SEQ ID NO: 438)<br>(SEQ ID NO: 822) | |
| TTR-238 | 5'-GGUGAAUCCAAGUGUCCUCUGAUGGUC-3'<br>3'-CCACUUAGGUUCACAGGAGACUACCAG-5'<br>Target: 5'-GGTGAATCCAAGTGTCCTCTGATGGTC-3' | (SEQ ID NO: 1975)<br>(SEQ ID NO: 439)<br>(SEQ ID NO: 823) | |
| TTR-239 | 5'-GUGAAUCCAAGUGUCCUCUGAUGGUCA-3'<br>3'-CACUUAGGUUCACAGGAGACUACCAGU-5'<br>Target: 5'-GTGAATCCAAGTGTCCTCTGATGGTCA-3' | (SEQ ID NO: 1976)<br>(SEQ ID NO: 440)<br>(SEQ ID NO: 824) | |
| TTR-240 | 5'-UGAAUCCAAGUGUCCUCUGAUGGUCAA-3'<br>3'-ACUUAGGUUCACAGGAGACUACCAGUU-5'<br>Target: 5'-TGAATCCAAGTGTCCTCTGATGGTCAA-3' | (SEQ ID NO: 1977)<br>(SEQ ID NO: 441)<br>(SEQ ID NO: 825) | |
| TTR-241 | 5'-GAAUCCAAGUGUCCUCUGAUGGUCAAA-3'<br>3'-CUUAGGUUCACAGGAGACUACCAGUUU-5'<br>Target: 5'-GAATCCAAGTGTCCTCTGATGGTCAAA-3' | (SEQ ID NO: 1978)<br>(SEQ ID NO: 442)<br>(SEQ ID NO: 826) | |
| TTR-242 | 5'-AAUCCAAGUGUCCUCUGAUGGUCAAAG-3'<br>3'-UUAGGUUCACAGGAGACUACCAGUUUC-5'<br>Target: 5'-AATCCAAGTGTCCTCTGATGGTCAAAG-3' | (SEQ ID NO: 1979)<br>(SEQ ID NO: 443)<br>(SEQ ID NO: 827) | |
| TTR-243 | 5'-AUCCAAGUGUCCUCUGAUGGUCAAAGU-3'<br>3'-UAGGUUCACAGGAGACUACCAGUUUCA-5'<br>Target: 5'-ATCCAAGTGTCCTCTGATGGTCAAAGT-3' | (SEQ ID NO: 1980)<br>(SEQ ID NO: 444)<br>(SEQ ID NO: 828) | |
| TTR-244 | 5'-UCCAAGUGUCCUCUGAUGGUCAAAGUU-3'<br>3'-AGGUUCACAGGAGACUACCAGUUUCAA-5'<br>Target: 5'-TCCAAGTGTCCTCTGATGGTCAAAGTT-3' | (SEQ ID NO: 1981)<br>(SEQ ID NO: 445)<br>(SEQ ID NO: 829) | |
| TTR-245 | 5'-CCAAGUGUCCUCUGAUGGUCAAAGUUC-3'<br>3'-GGUUCACAGGAGACUACCAGUUUCAAG-5'<br>Target: 5'-CCAAGTGTCCTCTGATGGTCAAAGTTC-3' | (SEQ ID NO: 1982)<br>(SEQ ID NO: 446)<br>(SEQ ID NO: 830) | |
| TTR-246 | 5'-CAAGUGUCCUCUGAUGGUCAAAGUUCU-3'<br>3'-GUUCACAGGAGACUACCAGUUUCAAGA-5'<br>Target: 5'-CAAGTGTCCTCTGATGGTCAAAGTTCT-3' | (SEQ ID NO: 1983)<br>(SEQ ID NO: 447)<br>(SEQ ID NO: 831) | |
| TTR-247 | 5'-AAGUGUCCUCUGAUGGUCAAAGUUCUA-3'<br>3'-UUCACAGGAGACUACCAGUUUCAAGAU-5'<br>Target: 5'-AAGTGTCCTCTGATGGTCAAAGTTCTA-3' | (SEQ ID NO: 1984)<br>(SEQ ID NO: 448)<br>(SEQ ID NO: 832) | |
| TTR-248 | 5'-AGUGUCCUCUGAUGGUCAAAGUUCUAG-3'<br>3'-UCACAGGAGACUACCAGUUUCAAGAUC-5'<br>Target: 5'-AGTGTCCTCTGATGGTCAAAGTTCTAG-3' | (SEQ ID NO: 1985)<br>(SEQ ID NO: 449)<br>(SEQ ID NO: 833) | |
| TTR-249 | 5'-GUGUCCUCUGAUGGUCAAAGUUCUAGA-3'<br>3'-CACAGGAGACUACCAGUUUCAAGAUCU-5'<br>Target: 5'-GTGTCCTCTGATGGTCAAAGTTCTAGA-3' | (SEQ ID NO: 1986)<br>(SEQ ID NO: 450)<br>(SEQ ID NO: 834) | |
| TTR-250 | 5'-UGUCCUCUGAUGGUCAAAGUUCUAGAU-3'<br>3'-ACAGGAGACUACCAGUUUCAAGAUCUA-5'<br>Target: 5'-TGTCCTCTGATGGTCAAAGTTCTAGAT-3' | (SEQ ID NO: 1987)<br>(SEQ ID NO: 451)<br>(SEQ ID NO: 835) | |

TABLE 5-continued

Selected Human Anti-Transthyretin "Blunt/Blunt" DsiRNAs

|  |  |  |  |
|---|---|---|---|
| TTR-251 | Target: | 5'-GUCCUCUGAUGGUCAAAGUUCUAGAUG-3'<br>3'-CAGGAGACUACCAGUUUCAAGAUCUAC-5'<br>5'-GTCCTCTGATGGTCAAAGTTCTAGATG-3' | (SEQ ID NO: 1988)<br>(SEQ ID NO: 452)<br>(SEQ ID NO: 836) |
| TTR-252 | Target: | 5'-UCCUCUGAUGGUCAAAGUUCUAGAUGC-3'<br>3'-AGGAGACUACCAGUUUCAAGAUCUACG-5'<br>5'-TCCTCTGATGGTCAAAGTTCTAGATGC-3' | (SEQ ID NO: 1989)<br>(SEQ ID NO: 453)<br>(SEQ ID NO: 837) |
| TTR-253 | Target: | 5'-CCUCUGAUGGUCAAAGUUCUAGAUGCU-3'<br>3'-GGAGACUACCAGUUUCAAGAUCUACGA-5'<br>5'-CCTCTGATGGTCAAAGTTCTAGATGCT-3' | (SEQ ID NO: 1990)<br>(SEQ ID NO: 454)<br>(SEQ ID NO: 838) |
| TTR-254 | Target: | 5'-CUCUGAUGGUCAAAGUUCUAGAUGCUG-3'<br>3'-GAGACUACCAGUUUCAAGAUCUACGAC-5'<br>5'-CTCTGATGGTCAAAGTTCTAGATGCTG-3' | (SEQ ID NO: 1991)<br>(SEQ ID NO: 455)<br>(SEQ ID NO: 839) |
| TTR-255 | Target: | 5'-UCUGAUGGUCAAAGUUCUAGAUGCUGU-3'<br>3'-AGACUACCAGUUUCAAGAUCUACGACA-5'<br>5'-TCTGATGGTCAAAGTTCTAGATGCTGT-3' | (SEQ ID NO: 1992)<br>(SEQ ID NO: 456)<br>(SEQ ID NO: 840) |
| TTR-256 | Target: | 5'-CUGAUGGUCAAAGUUCUAGAUGCUGUC-3'<br>3'-GACUACCAGUUUCAAGAUCUACGACAG-5'<br>5'-CTGATGGTCAAAGTTCTAGATGCTGTC-3' | (SEQ ID NO: 1993)<br>(SEQ ID NO: 457)<br>(SEQ ID NO: 841) |
| TTR-257 | Target: | 5'-UGAUGGUCAAAGUUCUAGAUGCUGUCC-3'<br>3'-ACUACCAGUUUCAAGAUCUACGACAGG-5'<br>5'-TGATGGTCAAAGTTCTAGATGCTGTCC-3' | (SEQ ID NO: 1994)<br>(SEQ ID NO: 458)<br>(SEQ ID NO: 842) |
| TTR-258 | Target: | 5'-GAUGGUCAAAGUUCUAGAUGCUGUCCG-3'<br>3'-CUACCAGUUUCAAGAUCUACGACAGGC-5'<br>5'-GATGGTCAAAGTTCTAGATGCTGTCCG-3' | (SEQ ID NO: 1995)<br>(SEQ ID NO: 459)<br>(SEQ ID NO: 843) |
| TTR-346 | Target: | 5'-GAGCCAUUUGCCUCUGGGAAAACCAGU-3'<br>3'-CUCGGUAAACGGAGACCCUUUUGGUCA-5'<br>5'-GAGCCATTTGCCTCTGGGAAAACCAGT-3' | (SEQ ID NO: 1996)<br>(SEQ ID NO: 460)<br>(SEQ ID NO: 844) |
| TTR-347 | Target: | 5'-AGCCAUUUGCCUCUGGGAAAACCAGUG-3'<br>3'-UCGGUAAACGGAGACCCUUUUGGUCAC-5'<br>5'-AGCCATTTGCCTCTGGGAAAACCAGTG-3' | (SEQ ID NO: 1997)<br>(SEQ ID NO: 461)<br>(SEQ ID NO: 845) |
| TTR-348 | Target: | 5'-GCCAUUUGCCUCUGGGAAAACCAGUGA-3'<br>3'-CGGUAAACGGAGACCCUUUUGGUCACU-5'<br>5'-GCCATTTGCCTCTGGGAAAACCAGTGA-3' | (SEQ ID NO: 1998)<br>(SEQ ID NO: 462)<br>(SEQ ID NO: 846) |
| TTR-349 | Target: | 5'-CCAUUUGCCUCUGGGAAAACCAGUGAG-3'<br>3'-GGUAAACGGAGACCCUUUUGGUCACUC-5'<br>5'-CCATTTGCCTCTGGGAAAACCAGTGAG-3' | (SEQ ID NO: 1999)<br>(SEQ ID NO: 463)<br>(SEQ ID NO: 847) |
| TTR-350 | Target: | 5'-CAUUUGCCUCUGGGAAAACCAGUGAGU-3'<br>3'-GUAAACGGAGACCCUUUUGGUCACUCA-5'<br>5'-CATTTGCCTCTGGGAAAACCAGTGAGT-3' | (SEQ ID NO: 2000)<br>(SEQ ID NO: 464)<br>(SEQ ID NO: 848) |
| TTR-351 | Target: | 5'-AUUUGCCUCUGGGAAAACCAGUGAGUC-3'<br>3'-UAAACGGAGACCCUUUUGGUCACUCAG-5'<br>5'-ATTTGCCTCTGGGAAAACCAGTGAGTC-3' | (SEQ ID NO: 2001)<br>(SEQ ID NO: 465)<br>(SEQ ID NO: 849) |
| TTR-352 | Target: | 5'-UUUGCCUCUGGGAAAACCAGUGAGUCU-3'<br>3'-AAACGGAGACCCUUUUGGUCACUCAGA-5'<br>5'-TTTGCCTCTGGGAAAACCAGTGAGTCT-3' | (SEQ ID NO: 2002)<br>(SEQ ID NO: 466)<br>(SEQ ID NO: 850) |
| TTR-353 | Target: | 5'-UUGCCUCUGGGAAAACCAGUGAGUCUG-3'<br>3'-AACGGAGACCCUUUUGGUCACUCAGAC-5'<br>5'-TTGCCTCTGGGAAAACCAGTGAGTCTG-3' | (SEQ ID NO: 2003)<br>(SEQ ID NO: 467)<br>(SEQ ID NO: 851) |
| TTR-354 | Target: | 5'-UGCCUCUGGGAAAACCAGUGAGUCUGG-3'<br>3'-ACGGAGACCCUUUUGGUCACUCAGACC-5'<br>5'-TGCCTCTGGGAAAACCAGTGAGTCTGG-3' | (SEQ ID NO: 2004)<br>(SEQ ID NO: 468)<br>(SEQ ID NO: 852) |
| TTR-355 | Target: | 5'-GCCUCUGGGAAAACCAGUGAGUCUGGA-3'<br>3'-CGGAGACCCUUUUGGUCACUCAGACCU-5'<br>5'-GCCTCTGGGAAAACCAGTGAGTCTGGA-3' | (SEQ ID NO: 2005)<br>(SEQ ID NO: 469)<br>(SEQ ID NO: 853) |
| TTR-356 | Target: | 5'-CCUCUGGGAAAACCAGUGAGUCUGGAG-3'<br>3'-GGAGACCCUUUUGGUCACUCAGACCUC-5'<br>5'-CCTCTGGGAAAACCAGTGAGTCTGGAG-3' | (SEQ ID NO: 2006)<br>(SEQ ID NO: 470)<br>(SEQ ID NO: 854) |

TABLE 5-continued

Selected Human Anti-Transthyretin "Blunt/Blunt" DsiRNAs

|  |  |  |  |
|---|---|---|---|
| TTR-357 | Target: | 5'-CUCUGGGAAAACCAGUGAGUCUGGAGA-3'<br>3'-GAGACCCUUUUGGUCACUCAGACCUCU-5'<br>5'-CTCTGGGAAAACCAGTGAGTCTGGAGA-3' | (SEQ ID NO: 2007)<br>(SEQ ID NO: 471)<br>(SEQ ID NO: 855) |
| TTR-358 | Target: | 5'-UCUGGGAAAACCAGUGAGUCUGGAGAG-3'<br>3'-AGACCCUUUUGGUCACUCAGACCUCUC-5'<br>5'-TCTGGGAAAACCAGTGAGTCTGGAGAG-3' | (SEQ ID NO: 2008)<br>(SEQ ID NO: 472)<br>(SEQ ID NO: 856) |
| TTR-359 | Target: | 5'-CUGGGAAAACCAGUGAGUCUGGAGAGC-3'<br>3'-GACCCUUUUGGUCACUCAGACCUCUCG-5'<br>5'-CTGGGAAAACCAGTGAGTCTGGAGAGC-3' | (SEQ ID NO: 2009)<br>(SEQ ID NO: 473)<br>(SEQ ID NO: 857) |
| TTR-360 | Target: | 5'-UGGGAAAACCAGUGAGUCUGGAGAGCU-3'<br>3'-ACCCUUUUGGUCACUCAGACCUCUCGA-5'<br>5'-TGGGAAAACCAGTGAGTCTGGAGAGCT-3' | (SEQ ID NO: 2010)<br>(SEQ ID NO: 474)<br>(SEQ ID NO: 858) |
| TTR-361 | Target: | 5'-GGGAAAACCAGUGAGUCUGGAGAGCUG-3'<br>3'-CCCUUUUGGUCACUCAGACCUCUCGAC-5'<br>5'-GGGAAAACCAGTGAGTCTGGAGAGCTG-3' | (SEQ ID NO: 2011)<br>(SEQ ID NO: 475)<br>(SEQ ID NO: 859) |
| TTR-381 | Target: | 5'-AGAGCUGCAUGGGCUCACAACUGAGGA-3'<br>3'-UCUCGACGUACCCGAGUGUUGACUCCU-5'<br>5'-AGAGCTGCATGGGCTCACAACTGAGGA-3' | (SEQ ID NO: 2012)<br>(SEQ ID NO: 476)<br>(SEQ ID NO: 860) |
| TTR-382 | Target: | 5'-GAGCUGCAUGGGCUCACAACUGAGGAG-3'<br>3'-CUCGACGUACCCGAGUGUUGACUCCUC-5'<br>5'-GAGCTGCATGGGCTCACAACTGAGGAG-3' | (SEQ ID NO: 2013)<br>(SEQ ID NO: 477)<br>(SEQ ID NO: 861) |
| TTR-383 | Target: | 5'-AGCUGCAUGGGCUCACAACUGAGGAGG-3'<br>3'-UCGACGUACCCGAGUGUUGACUCCUCC-5'<br>5'-AGCTGCATGGGCTCACAACTGAGGAGG-3' | (SEQ ID NO: 2014)<br>(SEQ ID NO: 478)<br>(SEQ ID NO: 862) |
| TTR-384 | Target: | 5'-GCUGCAUGGGCUCACAACUGAGGAGGA-3'<br>3'-CGACGUACCCGAGUGUUGACUCCUCCU-5'<br>5'-GCTGCATGGGCTCACAACTGAGGAGGA-3' | (SEQ ID NO: 2015)<br>(SEQ ID NO: 479)<br>(SEQ ID NO: 863) |
| TTR-385 | Target: | 5'-CUGCAUGGGCUCACAACUGAGGAGGAA-3'<br>3'-GACGUACCCGAGUGUUGACUCCUCCUU-5'<br>5'-CTGCATGGGCTCACAACTGAGGAGGAA-3' | (SEQ ID NO: 2016)<br>(SEQ ID NO: 480)<br>(SEQ ID NO: 864) |
| TTR-386 | Target: | 5'-UGCAUGGGCUCACAACUGAGGAGGAAU-3'<br>3'-ACGUACCCGAGUGUUGACUCCUCCUUA-5'<br>5'-TGCATGGGCTCACAACTGAGGAGGAAT-3' | (SEQ ID NO: 2017)<br>(SEQ ID NO: 481)<br>(SEQ ID NO: 865) |
| TTR-387 | Target: | 5'-GCAUGGGCUCACAACUGAGGAGGAAUU-3'<br>3'-CGUACCCGAGUGUUGACUCCUCCUUAA-5'<br>5'-GCATGGGCTCACAACTGAGGAGGAATT-3' | (SEQ ID NO: 2018)<br>(SEQ ID NO: 482)<br>(SEQ ID NO: 866) |
| TTR-388 | Target: | 5'-CAUGGGCUCACAACUGAGGAGGAAUUU-3'<br>3'-GUACCCGAGUGUUGACUCCUCCUUAAA-5'<br>5'-CATGGGCTCACAACTGAGGAGGAATTT-3' | (SEQ ID NO: 2019)<br>(SEQ ID NO: 483)<br>(SEQ ID NO: 867) |
| TTR-389 | Target: | 5'-AUGGGCUCACAACUGAGGAGGAAUUUG-3'<br>3'-UACCCGAGUGUUGACUCCUCCUUAAAC-5'<br>5'-ATGGGCTCACAACTGAGGAGGAATTTG-3' | (SEQ ID NO: 2020)<br>(SEQ ID NO: 484)<br>(SEQ ID NO: 868) |
| TTR-390 | Target: | 5'-UGGGCUCACAACUGAGGAGGAAUUUGU-3'<br>3'-ACCCGAGUGUUGACUCCUCCUUAAACA-5'<br>5'-TGGGCTCACAACTGAGGAGGAATTTGT-3' | (SEQ ID NO: 2021)<br>(SEQ ID NO: 485)<br>(SEQ ID NO: 869) |
| TTR-391 | Target: | 5'-GGGCUCACAACUGAGGAGGAAUUUGUA-3'<br>3'-CCCGAGUGUUGACUCCUCCUUAAACAU-5'<br>5'-GGGCTCACAACTGAGGAGGAATTTGTA-3' | (SEQ ID NO: 2022)<br>(SEQ ID NO: 486)<br>(SEQ ID NO: 870) |
| TTR-392 | Target: | 5'-GGCUCACAACUGAGGAGGAAUUUGUAG-3'<br>3'-CCGAGUGUUGACUCCUCCUUAAACAUC-5'<br>5'-GGCTCACAACTGAGGAGGAATTTGTAG-3' | (SEQ ID NO: 2023)<br>(SEQ ID NO: 487)<br>(SEQ ID NO: 871) |
| TTR-393 | Target: | 5'-GCUCACAACUGAGGAGGAAUUUGUAGA-3'<br>3'-CGAGUGUUGACUCCUCCUUAAACAUCU-5'<br>5'-GCTCACAACTGAGGAGGAATTTGTAGA-3' | (SEQ ID NO: 2024)<br>(SEQ ID NO: 488)<br>(SEQ ID NO: 872) |
| TTR-394 | Target: | 5'-CUCACAACUGAGGAGGAAUUUGUAGAA-3'<br>3'-GAGUGUUGACUCCUCCUUAAACAUCUU-5'<br>5'-CTCACAACTGAGGAGGAATTTGTAGAA-3' | (SEQ ID NO: 2025)<br>(SEQ ID NO: 489)<br>(SEQ ID NO: 873) |

TABLE 5-continued

Selected Human Anti-Transthyretin "Blunt/Blunt" DsiRNAs

|  |  |  |
|---|---|---|
| TTR-395 Target: | 5'-UCACAACUGAGGAGGAAUUUGUAGAAG-3'<br>3'-AGUGUUGACUCCUCCUUAAACAUCUUC-5'<br>5'-TCACAACTGAGGAGGAATTTGTAGAAG-3' | (SEQ ID NO: 2026)<br>(SEQ ID NO: 490)<br>(SEQ ID NO: 874) |
| TTR-396 Target: | 5'-CACAACUGAGGAGGAAUUUGUAGAAGG-3'<br>3'-GUGUUGACUCCUCCUUAAACAUCUUCC-5'<br>5'-CACAACTGAGGAGGAATTTGTAGAAGG-3' | (SEQ ID NO: 2027)<br>(SEQ ID NO: 491)<br>(SEQ ID NO: 875) |
| TTR-398 Target: | 5'-CAACUGAGGAGGAAUUUGUAGAAGGGA-3'<br>3'-GUUGACUCCUCCUUAAACAUCUUCCCU-5'<br>5'-CAACTGAGGAGGAATTTGTAGAAGGGA-3' | (SEQ ID NO: 2028)<br>(SEQ ID NO: 492)<br>(SEQ ID NO: 876) |
| TTR-399 Target: | 5'-AACUGAGGAGGAAUUUGUAGAAGGGAU-3'<br>3'-UUGACUCCUCCUUAAACAUCUUCCCUA-5'<br>5'-AACTGAGGAGGAATTTGTAGAAGGGAT-3' | (SEQ ID NO: 2029)<br>(SEQ ID NO: 493)<br>(SEQ ID NO: 877) |
| TTR-400 Target: | 5'-ACUGAGGAGGAAUUUGUAGAAGGGAUA-3'<br>3'-UGACUCCUCCUUAAACAUCUUCCCUAU-5'<br>5'-ACTGAGGAGGAATTTGTAGAAGGGATA-3' | (SEQ ID NO: 2030)<br>(SEQ ID NO: 494)<br>(SEQ ID NO: 878) |
| TTR-401 Target: | 5'-CUGAGGAGGAAUUUGUAGAAGGGAUAU-3'<br>3'-GACUCCUCCUUAAACAUCUUCCCUAUA-5'<br>5'-CTGAGGAGGAATTTGTAGAAGGGATAT-3' | (SEQ ID NO: 2031)<br>(SEQ ID NO: 495)<br>(SEQ ID NO: 879) |
| TTR-402 Target: | 5'-UGAGGAGGAAUUUGUAGAAGGGAUAUA-3'<br>3'-ACUCCUCCUUAAACAUCUUCCCUAUAU-5'<br>5'-TGAGGAGGAATTTGTAGAAGGGATATA-3' | (SEQ ID NO: 2032)<br>(SEQ ID NO: 496)<br>(SEQ ID NO: 880) |
| TTR-403 Target: | 5'-GAGGAGGAAUUUGUAGAAGGGAUAUAC-3'<br>3'-CUCCUCCUUAAACAUCUUCCCUAUAUG-5'<br>5'-GAGGAGGAATTTGTAGAAGGGATATAC-3' | (SEQ ID NO: 2033)<br>(SEQ ID NO: 497)<br>(SEQ ID NO: 881) |
| TTR-404 Target: | 5'-AGGAGGAAUUUGUAGAAGGGAUAUACA-3'<br>3'-UCCUCCUUAAACAUCUUCCCUAUAUGU-5'<br>5'-AGGAGGAATTTGTAGAAGGGATATACA-3' | (SEQ ID NO: 2034)<br>(SEQ ID NO: 498)<br>(SEQ ID NO: 882) |
| TTR-405 Target: | 5'-GGAGGAAUUUGUAGAAGGGAUAUACAA-3'<br>3'-CCUCCUUAAACAUCUUCCCUAUAUGUU-5'<br>5'-GGAGGAATTTGTAGAAGGGATATACAA-3' | (SEQ ID NO: 2035)<br>(SEQ ID NO: 499)<br>(SEQ ID NO: 883) |
| TTR-406 Target: | 5'-GAGGAAUUUGUAGAAGGGAUAUACAAA-3'<br>3'-CUCCUUAAACAUCUUCCCUAUAUGUUU-5'<br>5'-GAGGAATTTGTAGAAGGGATATACAAA-3' | (SEQ ID NO: 2036)<br>(SEQ ID NO: 500)<br>(SEQ ID NO: 884) |
| TTR-407 Target: | 5'-AGGAAUUUGUAGAAGGGAUAUACAAAG-3'<br>3'-UCCUUAAACAUCUUCCCUAUAUGUUUC-5'<br>5'-AGGAATTTGTAGAAGGGATATACAAAG-3' | (SEQ ID NO: 2037)<br>(SEQ ID NO: 501)<br>(SEQ ID NO: 885) |
| TTR-408 Target: | 5'-GGAAUUUGUAGAAGGGAUAUACAAAGU-3'<br>3'-CCUUAAACAUCUUCCCUAUAUGUUUCA-5'<br>5'-GGAATTTGTAGAAGGGATATACAAAGT-3' | (SEQ ID NO: 2038)<br>(SEQ ID NO: 502)<br>(SEQ ID NO: 886) |
| TTR-409 Target: | 5'-GAAUUUGUAGAAGGGAUAUACAAAGUG-3'<br>3'-CUUAAACAUCUUCCCUAUAUGUUUCAC-5'<br>5'-GAATTTGTAGAAGGGATATACAAAGTG-3' | (SEQ ID NO: 2039)<br>(SEQ ID NO: 503)<br>(SEQ ID NO: 887) |
| TTR-410 Target: | 5'-AAUUUGUAGAAGGGAUAUACAAAGUGG-3'<br>3'-UUAAACAUCUUCCCUAUAUGUUUCACC-5'<br>5'-AATTTGTAGAAGGGATATACAAAGTGG-3' | (SEQ ID NO: 2040)<br>(SEQ ID NO: 504)<br>(SEQ ID NO: 888) |
| TTR-411 Target: | 5'-AUUUGUAGAAGGGAUAUACAAAGUGGA-3'<br>3'-UAAACAUCUUCCCUAUAUGUUUCACCU-5'<br>5'-ATTTGTAGAAGGGATATACAAAGTGGA-3' | (SEQ ID NO: 2041)<br>(SEQ ID NO: 505)<br>(SEQ ID NO: 889) |
| TTR-412 Target: | 5'-UUUGUAGAAGGGAUAUACAAAGUGGAA-3'<br>3'-AAACAUCUUCCCUAUAUGUUUCACCUU-5'<br>5'-TTTGTAGAAGGGATATACAAAGTGGAA-3' | (SEQ ID NO: 2042)<br>(SEQ ID NO: 506)<br>(SEQ ID NO: 890) |
| TTR-413 Target: | 5'-UUGUAGAAGGGAUAUACAAAGUGGAAA-3'<br>3'-AACAUCUUCCCUAUAUGUUUCACCUUU-5'<br>5'-TTGTAGAAGGGATATACAAAGTGGAAA-3' | (SEQ ID NO: 2043)<br>(SEQ ID NO: 507)<br>(SEQ ID NO: 891) |
| TTR-414 Target: | 5'-UGUAGAAGGGAUAUACAAAGUGGAAAU-3'<br>3'-ACAUCUUCCCUAUAUGUUUCACCUUUA-5'<br>5'-TGTAGAAGGGATATACAAAGTGGAAAT-3' | (SEQ ID NO: 2044)<br>(SEQ ID NO: 508)<br>(SEQ ID NO: 892) |

TABLE 5-continued

Selected Human Anti-Transthyretin "Blunt/Blunt" DsiRNAs

| | | |
|---|---|---|
| TTR-415 Target: | 5'-GUAGAAGGGAUAUACAAAGUGGAAAUA-3'<br>3'-CAUCUUCCCUAUAUGUUUCACCUUUAU-5'<br>5'-GTAGAAGGGATATACAAAGTGGAAATA-3' | (SEQ ID NO: 2045)<br>(SEQ ID NO: 509)<br>(SEQ ID NO: 893) |
| TTR-416 Target: | 5'-UAGAAGGGAUAUACAAAGUGGAAAUAG-3'<br>3'-AUCUUCCCUAUAUGUUUCACCUUUAUC-5'<br>5'-TAGAAGGGATATACAAAGTGGAAATAG-3' | (SEQ ID NO: 2046)<br>(SEQ ID NO: 510)<br>(SEQ ID NO: 894) |
| TTR-417 Target: | 5'-AGAAGGGAUAUACAAAGUGGAAAUAGA-3'<br>3'-UCUUCCCUAUAUGUUUCACCUUUAUCU-5'<br>5'-AGAAGGGATATACAAAGTGGAAATAGA-3' | (SEQ ID NO: 2047)<br>(SEQ ID NO: 511)<br>(SEQ ID NO: 895) |
| TTR-418 Target: | 5'-GAAGGGAUAUACAAAGUGGAAAUAGAC-3'<br>3'-CUUCCCUAUAUGUUUCACCUUUAUCUG-5'<br>5'-GAAGGGATATACAAAGTGGAAATAGAC-3' | (SEQ ID NO: 2048)<br>(SEQ ID NO: 512)<br>(SEQ ID NO: 896) |
| TTR-419 Target: | 5'-AAGGGAUAUACAAAGUGGAAAUAGACA-3'<br>3'-UUCCCUAUAUGUUUCACCUUUAUCUGU-5'<br>5'-AAGGGATATACAAAGTGGAAATAGACA-3' | (SEQ ID NO: 2049)<br>(SEQ ID NO: 513)<br>(SEQ ID NO: 897) |
| TTR-420 Target: | 5'-AGGGAUAUACAAAGUGGAAAUAGACAC-3'<br>3'-UCCCUAUAUGUUUCACCUUUAUCUGUG-5'<br>5'-AGGGATATACAAAGTGGAAATAGACAC-3' | (SEQ ID NO: 2050)<br>(SEQ ID NO: 514)<br>(SEQ ID NO: 898) |
| TTR-421 Target: | 5'-GGGAUAUACAAAGUGGAAAUAGACACC-3'<br>3'-CCCUAUAUGUUUCACCUUUAUCUGUGG-5'<br>5'-GGGATATACAAAGTGGAAATAGACACC-3' | (SEQ ID NO: 2051)<br>(SEQ ID NO: 515)<br>(SEQ ID NO: 899) |
| TTR-422 Target: | 5'-GGAUAUACAAAGUGGAAAUAGACACCA-3'<br>3'-CCUAUAUGUUUCACCUUUAUCUGUGGU-5'<br>5'-GGATATACAAAGTGGAAATAGACACCA-3' | (SEQ ID NO: 2052)<br>(SEQ ID NO: 516)<br>(SEQ ID NO: 900) |
| TTR-423 Target: | 5'-GAUAUACAAAGUGGAAAUAGACACCAA-3'<br>3'-CUAUAUGUUUCACCUUUAUCUGUGGUU-5'<br>5'-GATATACAAAGTGGAAATAGACACCAA-3' | (SEQ ID NO: 2053)<br>(SEQ ID NO: 517)<br>(SEQ ID NO: 901) |
| TTR-424 Target: | 5'-AUAUACAAAGUGGAAAUAGACACCAAA-3'<br>3'-UAUAUGUUUCACCUUUAUCUGUGGUUU-5'<br>5'-ATATACAAAGTGGAAATAGACACCAAA-3' | (SEQ ID NO: 2054)<br>(SEQ ID NO: 518)<br>(SEQ ID NO: 902) |
| TTR-425 Target: | 5'-UAUACAAAGUGGAAAUAGACACCAAAU-3'<br>3'-AUAUGUUUCACCUUUAUCUGUGGUUUA-5'<br>5'-TATACAAAGTGGAAATAGACACCAAAT-3' | (SEQ ID NO: 2055)<br>(SEQ ID NO: 519)<br>(SEQ ID NO: 903) |
| TTR-426 Target: | 5'-AUACAAAGUGGAAAUAGACACCAAAUC-3'<br>3'-UAUGUUUCACCUUUAUCUGUGGUUUAG-5'<br>5'-ATACAAAGTGGAAATAGACACCAAATC-3' | (SEQ ID NO: 2056)<br>(SEQ ID NO: 520)<br>(SEQ ID NO: 904) |
| TTR-427 Target: | 5'-UACAAAGUGGAAAUAGACACCAAAUCU-3'<br>3'-AUGUUUCACCUUUAUCUGUGGUUUAGA-5'<br>5'-TACAAAGTGGAAATAGACACCAAATCT-3' | (SEQ ID NO: 2057)<br>(SEQ ID NO: 521)<br>(SEQ ID NO: 905) |
| TTR-428 Target: | 5'-ACAAAGUGGAAAUAGACACCAAAUCUU-3'<br>3'-UGUUUCACCUUUAUCUGUGGUUUAGAA-5'<br>5'-ACAAAGTGGAAATAGACACCAAATCTT-3' | (SEQ ID NO: 2058)<br>(SEQ ID NO: 522)<br>(SEQ ID NO: 906) |
| TTR-429 Target: | 5'-CAAAGUGGAAAUAGACACCAAAUCUUA-3'<br>3'-GUUUCACCUUUAUCUGUGGUUUAGAAU-5'<br>5'-CAAAGTGGAAATAGACACCAAATCTTA-3' | (SEQ ID NO: 2059)<br>(SEQ ID NO: 523)<br>(SEQ ID NO: 907) |
| TTR-430 Target: | 5'-AAAGUGGAAAUAGACACCAAAUCUUAC-3'<br>3'-UUUCACCUUUAUCUGUGGUUUAGAAUG-5'<br>5'-AAAGTGGAAATAGACACCAAATCTTAC-3' | (SEQ ID NO: 2060)<br>(SEQ ID NO: 524)<br>(SEQ ID NO: 908) |
| TTR-431 Target: | 5'-AAGUGGAAAUAGACACCAAAUCUUACU-3'<br>3'-UUCACCUUUAUCUGUGGUUUAGAAUGA-5'<br>5'-AAGTGGAAATAGACACCAAATCTTACT-3' | (SEQ ID NO: 2061)<br>(SEQ ID NO: 525)<br>(SEQ ID NO: 909) |
| TTR-432 Target: | 5'-AGUGGAAAUAGACACCAAAUCUUACUG-3'<br>3'-UCACCUUUAUCUGUGGUUUAGAAUGAC-5'<br>5'-AGTGGAAATAGACACCAAATCTTACTG-3' | (SEQ ID NO: 2062)<br>(SEQ ID NO: 526)<br>(SEQ ID NO: 910) |
| TTR-433 Target: | 5'-GUGGAAAUAGACACCAAAUCUUACUGG-3'<br>3'-CACCUUUAUCUGUGGUUUAGAAUGACC-5'<br>5'-GTGGAAATAGACACCAAATCTTACTGG-3' | (SEQ ID NO: 2063)<br>(SEQ ID NO: 527)<br>(SEQ ID NO: 911) |

TABLE 5-continued

Selected Human Anti-Transthyretin "Blunt/Blunt" DsiRNAs

|  |  |  |
| --- | --- | --- |
| TTR-434 Target: | 5'-UGGAAAUAGACACCAAAUCUUACUGGA-3'<br>3'-ACCUUUAUCUGUGGUUUAGAAUGACCU-5'<br>5'-TGGAAATAGACACCAAATCTTACTGGA-3' | (SEQ ID NO: 2064)<br>(SEQ ID NO: 528)<br>(SEQ ID NO: 912) |
| TTR-435 Target: | 5'-GGAAAUAGACACCAAAUCUUACUGGAA-3'<br>3'-CCUUUAUCUGUGGUUUAGAAUGACCUU-5'<br>5'-GGAAATAGACACCAAATCTTACTGGAA-3' | (SEQ ID NO: 2065)<br>(SEQ ID NO: 529)<br>(SEQ ID NO: 913) |
| TTR-436 Target: | 5'-GAAAUAGACACCAAAUCUUACUGGAAG-3'<br>3'-CUUUAUCUGUGGUUUAGAAUGACCUUC-5'<br>5'-GAAATAGACACCAAATCTTACTGGAAG-3' | (SEQ ID NO: 2066)<br>(SEQ ID NO: 530)<br>(SEQ ID NO: 914) |
| TTR-437 Target: | 5'-AAAUAGACACCAAAUCUUACUGGAAGG-3'<br>3'-UUUAUCUGUGGUUUAGAAUGACCUUCC-5'<br>5'-AAATAGACACCAAATCTTACTGGAAGG-3' | (SEQ ID NO: 2067)<br>(SEQ ID NO: 531)<br>(SEQ ID NO: 915) |
| TTR-439 Target: | 5'-AUAGACACCAAAUCUUACUGGAAGGCA-3'<br>3'-UAUCUGUGGUUUAGAAUGACCUUCCGU-5'<br>5'-ATAGACACCAAATCTTACTGGAAGGCA-3' | (SEQ ID NO: 2068)<br>(SEQ ID NO: 532)<br>(SEQ ID NO: 916) |
| TTR-440 Target: | 5'-UAGACACCAAAUCUUACUGGAAGGCAC-3'<br>3'-AUCUGUGGUUUAGAAUGACCUUCCGUG-5'<br>5'-TAGACACCAAATCTTACTGGAAGGCAC-3' | (SEQ ID NO: 2069)<br>(SEQ ID NO: 533)<br>(SEQ ID NO: 917) |
| TTR-462 Target: | 5'-GGCACUUGGCAUCUCCCCAUUCCAUGA-3'<br>3'-CCGUGAACCGUAGAGGGGUAAGGUACU-5'<br>5'-GGCACTTGGCATCTCCCCATTCCATGA-3' | (SEQ ID NO: 2070)<br>(SEQ ID NO: 534)<br>(SEQ ID NO: 918) |
| TTR-463 Target: | 5'-GCACUUGGCAUCUCCCCAUUCCAUGAG-3'<br>3'-CGUGAACCGUAGAGGGGUAAGGUACUC-5'<br>5'-GCACTTGGCATCTCCCCATTCCATGAG-3' | (SEQ ID NO: 2071)<br>(SEQ ID NO: 535)<br>(SEQ ID NO: 919) |
| TTR-464 Target: | 5'-CACUUGGCAUCUCCCCAUUCCAUGAGC-3'<br>3'-GUGAACCGUAGAGGGGUAAGGUACUCG-5'<br>5'-CACTTGGCATCTCCCCATTCCATGAGC-3' | (SEQ ID NO: 2072)<br>(SEQ ID NO: 536)<br>(SEQ ID NO: 920) |
| TTR-465 Target: | 5'-ACUUGGCAUCUCCCCAUUCCAUGAGCA-3'<br>3'-UGAACCGUAGAGGGGUAAGGUACUCGU-5'<br>5'-ACTTGGCATCTCCCCATTCCATGAGCA-3' | (SEQ ID NO: 2073)<br>(SEQ ID NO: 537)<br>(SEQ ID NO: 921) |
| TTR-466 Target: | 5'-CUUGGCAUCUCCCCAUUCCAUGAGCAU-3'<br>3'-GAACCGUAGAGGGGUAAGGUACUCGUA-5'<br>5'-CTTGGCATCTCCCCATTCCATGAGCAT-3' | (SEQ ID NO: 2074)<br>(SEQ ID NO: 538)<br>(SEQ ID NO: 922) |
| TTR-467 Target: | 5'-UUGGCAUCUCCCCAUUCCAUGAGCAUG-3'<br>3'-AACCGUAGAGGGGUAAGGUACUCGUAC-5'<br>5'-TTGGCATCTCCCCATTCCATGAGCATG-3' | (SEQ ID NO: 2075)<br>(SEQ ID NO: 539)<br>(SEQ ID NO: 923) |
| TTR-468 Target: | 5'-UGGCAUCUCCCCAUUCCAUGAGCAUGC-3'<br>3'-ACCGUAGAGGGGUAAGGUACUCGUACG-5'<br>5'-TGGCATCTCCCCATTCCATGAGCATGC-3' | (SEQ ID NO: 2076)<br>(SEQ ID NO: 540)<br>(SEQ ID NO: 924) |
| TTR-469 Target: | 5'-GGCAUCUCCCCAUUCCAUGAGCAUGCA-3'<br>3'-CCGUAGAGGGGUAAGGUACUCGUACGU-5'<br>5'-GGCATCTCCCCATTCCATGAGCATGCA-3' | (SEQ ID NO: 2077)<br>(SEQ ID NO: 541)<br>(SEQ ID NO: 925) |
| TTR-470 Target: | 5'-GCAUCUCCCCAUUCCAUGAGCAUGCAG-3'<br>3'-CGUAGAGGGGUAAGGUACUCGUACGUC-5'<br>5'-GCATCTCCCCATTCCATGAGCATGCAG-3' | (SEQ ID NO: 2078)<br>(SEQ ID NO: 542)<br>(SEQ ID NO: 926) |
| TTR-471 Target: | 5'-CAUCUCCCCAUUCCAUGAGCAUGCAGA-3'<br>3'-GUAGAGGGGUAAGGUACUCGUACGUCU-5'<br>5'-CATCTCCCCATTCCATGAGCATGCAGA-3' | (SEQ ID NO: 2079)<br>(SEQ ID NO: 543)<br>(SEQ ID NO: 927) |
| TTR-472 Target: | 5'-AUCUCCCCAUUCCAUGAGCAUGCAGAG-3'<br>3'-UAGAGGGGUAAGGUACUCGUACGUCUC-5'<br>5'-ATCTCCCCATTCCATGAGCATGCAGAG-3' | (SEQ ID NO: 2080)<br>(SEQ ID NO: 544)<br>(SEQ ID NO: 928) |
| TTR-473 Target: | 5'-UCUCCCCAUUCCAUGAGCAUGCAGAGG-3'<br>3'-AGAGGGGUAAGGUACUCGUACGUCUCC-5'<br>5'-TCTCCCCATTCCATGAGCATGCAGAGG-3' | (SEQ ID NO: 2081)<br>(SEQ ID NO: 545)<br>(SEQ ID NO: 929) |
| TTR-474 Target: | 5'-CUCCCCAUUCCAUGAGCAUGCAGAGGU-3'<br>3'-GAGGGGUAAGGUACUCGUACGUCUCCA-5'<br>5'-CTCCCCATTCCATGAGCATGCAGAGGT-3' | (SEQ ID NO: 2082)<br>(SEQ ID NO: 546)<br>(SEQ ID NO: 930) |

TABLE 5-continued

Selected Human Anti-Transthyretin "Blunt/Blunt" DsiRNAs

| | | |
|---|---|---|
| TTR-482 Target: | 5'-UCCAUGAGCAUGCAGAGGUGGUAUUCA-3'<br>3'-AGGUACUCGUACGUCUCCACCAUAAGU-5'<br>5'-TCCATGAGCATGCAGAGGTGGTATTCA-3' | (SEQ ID NO: 2083)<br>(SEQ ID NO: 547)<br>(SEQ ID NO: 931) |
| TTR-483 Target: | 5'-CCAUGAGCAUGCAGAGGUGGUAUUCAC-3'<br>3'-GGUACUCGUACGUCUCCACCAUAAGUG-5'<br>5'-CCATGAGCATGCAGAGGTGGTATTCAC-3' | (SEQ ID NO: 2084)<br>(SEQ ID NO: 548)<br>(SEQ ID NO: 932) |
| TTR-484 Target: | 5'-CAUGAGCAUGCAGAGGUGGUAUUCACA-3'<br>3'-GUACUCGUACGUCUCCACCAUAAGUGU-5'<br>5'-CATGAGCATGCAGAGGTGGTATTCACA-3' | (SEQ ID NO: 2085)<br>(SEQ ID NO: 549)<br>(SEQ ID NO: 933) |
| TTR-485 Target: | 5'-AUGAGCAUGCAGAGGUGGUAUUCACAG-3'<br>3'-UACUCGUACGUCUCCACCAUAAGUGUC-5'<br>5'-ATGAGCATGCAGAGGTGGTATTCACAG-3' | (SEQ ID NO: 2086)<br>(SEQ ID NO: 550)<br>(SEQ ID NO: 934) |
| TTR-489 Target: | 5'-GCAUGCAGAGGUGGUAUUCACAGCCAA-3'<br>3'-CGUACGUCUCCACCAUAAGUGUCGGUU-5'<br>5'-GCATGCAGAGGTGGTATTCACAGCCAA-3' | (SEQ ID NO: 2087)<br>(SEQ ID NO: 551)<br>(SEQ ID NO: 935) |
| TTR-493 Target: | 5'-GCAGAGGUGGUAUUCACAGCCAACGAC-3'<br>3'-CGUCUCCACCAUAAGUGUCGGUUGCUG-5'<br>5'-GCAGAGGTGGTATTCACAGCCAACGAC-3' | (SEQ ID NO: 2088)<br>(SEQ ID NO: 552)<br>(SEQ ID NO: 936) |
| TTR-494 Target: | 5'-CAGAGGUGGUAUUCACAGCCAACGACU-3'<br>3'-GUCUCCACCAUAAGUGUCGGUUGCUGA-5'<br>5'-CAGAGGTGGTATTCACAGCCAACGACT-3' | (SEQ ID NO: 2089)<br>(SEQ ID NO: 553)<br>(SEQ ID NO: 937) |
| TTR-581 Target: | 5'-CUGUCGUCACCAAUCCCAAGGAAUGAG-3'<br>3'-GACAGCAGUGGUUAGGGUUCCUUACUC-5'<br>5'-CTGTCGTCACCAATCCCAAGGAATGAG-3' | (SEQ ID NO: 2090)<br>(SEQ ID NO: 554)<br>(SEQ ID NO: 938) |
| TTR-631 Target: | 5'-AAGGACGAGGGAUGGGAUUUCAUGUAA-3'<br>3'-UUCCUGCUCCCUACCCUAAAGUACAUU-5'<br>5'-AAGGACGAGGGATGGGATTTCATGTAA-3' | (SEQ ID NO: 2091)<br>(SEQ ID NO: 555)<br>(SEQ ID NO: 939) |
| TTR-632 Target: | 5'-AGGACGAGGGAUGGGAUUUCAUGUAAC-3'<br>3'-UCCUGCUCCCUACCCUAAAGUACAUUG-5'<br>5'-AGGACGAGGGATGGGATTTCATGTAAC-3' | (SEQ ID NO: 2092)<br>(SEQ ID NO: 556)<br>(SEQ ID NO: 940) |
| TTR-635 Target: | 5'-ACGAGGGAUGGGAUUUCAUGUAACCAA-3'<br>3'-UGCUCCCUACCCUAAAGUACAUUGGUU-5'<br>5'-ACGAGGGATGGGATTTCATGTAACCAA-3' | (SEQ ID NO: 2093)<br>(SEQ ID NO: 557)<br>(SEQ ID NO: 941) |
| TTR-636 Target: | 5'-CGAGGGAUGGGAUUUCAUGUAACCAAG-3'<br>3'-GCUCCCUACCCUAAAGUACAUUGGUUC-5'<br>5'-CGAGGGATGGGATTTCATGTAACCAAG-3' | (SEQ ID NO: 2094)<br>(SEQ ID NO: 558)<br>(SEQ ID NO: 942) |
| TTR-637 Target: | 5'-GAGGGAUGGGAUUUCAUGUAACCAAGA-3'<br>3'-CUCCCUACCCUAAAGUACAUUGGUUCU-5'<br>5'-GAGGGATGGGATTTCATGTAACCAAGA-3' | (SEQ ID NO: 2095)<br>(SEQ ID NO: 559)<br>(SEQ ID NO: 943) |
| TTR-639 Target: | 5'-GGGAUGGGAUUUCAUGUAACCAAGAGU-3'<br>3'-CCCUACCCUAAAGUACAUUGGUUCUCA-5'<br>5'-GGGATGGGATTTCATGTAACCAAGAGT-3' | (SEQ ID NO: 2096)<br>(SEQ ID NO: 560)<br>(SEQ ID NO: 944) |
| TTR-640 Target: | 5'-GGAUGGGAUUUCAUGUAACCAAGAGUA-3'<br>3'-CCUACCCUAAAGUACAUUGGUUCUCAU-5'<br>5'-GGATGGGATTTCATGTAACCAAGAGTA-3' | (SEQ ID NO: 2097)<br>(SEQ ID NO: 561)<br>(SEQ ID NO: 945) |
| TTR-641 Target: | 5'-GAUGGGAUUUCAUGUAACCAAGAGUAU-3'<br>3'-CUACCCUAAAGUACAUUGGUUCUCAUA-5'<br>5'-GATGGGATTTCATGTAACCAAGAGTAT-3' | (SEQ ID NO: 2098)<br>(SEQ ID NO: 562)<br>(SEQ ID NO: 946) |
| TTR-642 Target: | 5'-AUGGGAUUUCAUGUAACCAAGAGUAUU-3'<br>3'-UACCCUAAAGUACAUUGGUUCUCAUAA-5'<br>5'-ATGGGATTTCATGTAACCAAGAGTATT-3' | (SEQ ID NO: 2099)<br>(SEQ ID NO: 563)<br>(SEQ ID NO: 947) |
| TTR-643 Target: | 5'-UGGGAUUUCAUGUAACCAAGAGUAUUC-3'<br>3'-ACCCUAAAGUACAUUGGUUCUCAUAAG-5'<br>5'-TGGGATTTCATGTAACCAAGAGTATTC-3' | (SEQ ID NO: 2100)<br>(SEQ ID NO: 564)<br>(SEQ ID NO: 948) |
| TTR-644 Target: | 5'-GGGAUUUCAUGUAACCAAGAGUAUUCC-3'<br>3'-CCCUAAAGUACAUUGGUUCUCAUAAGG-5'<br>5'-GGGATTTCATGTAACCAAGAGTATTCC-3' | (SEQ ID NO: 2101)<br>(SEQ ID NO: 565)<br>(SEQ ID NO: 949) |

TABLE 5-continued

Selected Human Anti-Transthyretin "Blunt/Blunt" DsiRNAs

```
                5'-GGAUUUCAUGUAACCAAGAGUAUUCCA-3'      (SEQ ID NO: 2102)
                3'-CCUAAAGUACAUUGGUUCUCAUAAGGU-5'      (SEQ ID NO: 566)
TTR-645 Target: 5'-GGATTTCATGTAACCAAGAGTATTCCA-3'      (SEQ ID NO: 950)

5'-GAUUUCAUGUAACCAAGAGUAUUCCAU-3'      (SEQ ID NO: 2103)
                3'-CUAAAGUACAUUGGUUCUCAUAAGGUA-5'      (SEQ ID NO: 567)
TTR-646 Target: 5'-GATTTCATGTAACCAAGAGTATTCCAT-3'      (SEQ ID NO: 951)

5'-AUUUCAUGUAACCAAGAGUAUUCCAUU-3'      (SEQ ID NO: 2104)
                3'-UAAAGUACAUUGGUUCUCAUAAGGUAA-5'      (SEQ ID NO: 568)
TTR-647 Target: 5'-ATTTCATGTAACCAAGAGTATTCCATT-3'      (SEQ ID NO: 952)

5'-UUUCAUGUAACCAAGAGUAUUCCAUUU-3'      (SEQ ID NO: 2105)
                3'-AAAGUACAUUGGUUCUCAUAAGGUAAA-5'      (SEQ ID NO: 569)
TTR-648 Target: 5'-TTTCATGTAACCAAGAGTATTCCATTT-3'      (SEQ ID NO: 953)

5'-UUCAUGUAACCAAGAGUAUUCCAUUUU-3'      (SEQ ID NO: 2106)
                3'-AAGUACAUUGGUUCUCAUAAGGUAAAA-5'      (SEQ ID NO: 570)
TTR-649 Target: 5'-TTCATGTAACCAAGAGTATTCCATTTT-3'      (SEQ ID NO: 954)

5'-UCAUGUAACCAAGAGUAUUCCAUUUUU-3'      (SEQ ID NO: 2107)
                3'-AGUACAUUGGUUCUCAUAAGGUAAAAA-5'      (SEQ ID NO: 571)
TTR-650 Target: 5'-TCATGTAACCAAGAGTATTCCATTTTT-3'      (SEQ ID NO: 955)

5'-CAUGUAACCAAGAGUAUUCCAUUUUUA-3'      (SEQ ID NO: 2108)
                3'-GUACAUUGGUUCUCAUAAGGUAAAAAU-5'      (SEQ ID NO: 572)
TTR-651 Target: 5'-CATGTAACCAAGAGTATTCCATTTTTA-3'      (SEQ ID NO: 956)

5'-AUGUAACCAAGAGUAUUCCAUUUUUAC-3'      (SEQ ID NO: 2109)
                3'-UACAUUGGUUCUCAUAAGGUAAAAAUG-5'      (SEQ ID NO: 573)
TTR-652 Target: 5'-ATGTAACCAAGAGTATTCCATTTTTAC-3'      (SEQ ID NO: 957)

5'-UGUAACCAAGAGUAUUCCAUUUUUACU-3'      (SEQ ID NO: 2110)
                3'-ACAUUGGUUCUCAUAAGGUAAAAAUGA-5'      (SEQ ID NO: 574)
TTR-653 Target: 5'-TGTAACCAAGAGTATTCCATTTTTACT-3'      (SEQ ID NO: 958)

5'-GUAACCAAGAGUAUUCCAUUUUUACUA-3'      (SEQ ID NO: 2111)
                3'-CAUUGGUUCUCAUAAGGUAAAAAUGAU-5'      (SEQ ID NO: 575)
TTR-654 Target: 5'-GTAACCAAGAGTATTCCATTTTTACTA-3'      (SEQ ID NO: 959)

5'-UAACCAAGAGUAUUCCAUUUUUACUAA-3'      (SEQ ID NO: 2112)
                3'-AUUGGUUCUCAUAAGGUAAAAAUGAUU-5'      (SEQ ID NO: 576)
TTR-655 Target: 5'-TAACCAAGAGTATTCCATTTTTACTAA-3'      (SEQ ID NO: 960)

5'-AACCAAGAGUAUUCCAUUUUUACUAAA-3'      (SEQ ID NO: 2113)
                3'-UUGGUUCUCAUAAGGUAAAAAUGAUUU-5'      (SEQ ID NO: 577)
TTR-656 Target: 5'-AACCAAGAGTATTCCATTTTTACTAAA-3'      (SEQ ID NO: 961)

5'-ACCAAGAGUAUUCCAUUUUUACUAAAG-3'      (SEQ ID NO: 2114)
                3'-UGGUUCUCAUAAGGUAAAAAUGAUUUC-5'      (SEQ ID NO: 578)
TTR-657 Target: 5'-ACCAAGAGTATTCCATTTTTACTAAAG-3'      (SEQ ID NO: 962)

5'-CCAAGAGUAUUCCAUUUUUACUAAAGC-3'      (SEQ ID NO: 2115)
                3'-GGUUCUCAUAAGGUAAAAAUGAUUUCG-5'      (SEQ ID NO: 579)
TTR-658 Target: 5'-CCAAGAGTATTCCATTTTTACTAAAGC-3'      (SEQ ID NO: 963)

5'-CAAGAGUAUUCCAUUUUUACUAAAGCA-3'      (SEQ ID NO: 2116)
                3'-GUUCUCAUAAGGUAAAAAUGAUUUCGU-5'      (SEQ ID NO: 580)
TTR-659 Target: 5'-CAAGAGTATTCCATTTTTACTAAAGCA-3'      (SEQ ID NO: 964)

5'-AAGAGUAUUCCAUUUUUACUAAAGCAG-3'      (SEQ ID NO: 2117)
                3'-UUCUCAUAAGGUAAAAAUGAUUUCGUC-5'      (SEQ ID NO: 581)
TTR-660 Target: 5'-AAGAGTATTCCATTTTTACTAAAGCAG-3'      (SEQ ID NO: 965)

5'-AGAGUAUUCCAUUUUUACUAAAGCAGU-3'      (SEQ ID NO: 2118)
                3'-UCUCAUAAGGUAAAAAUGAUUUCGUCA-5'      (SEQ ID NO: 582)
TTR-661 Target: 5'-AGAGTATTCCATTTTTACTAAAGCAGT-3'      (SEQ ID NO: 966)

5'-GAGUAUUCCAUUUUUACUAAAGCAGUG-3'      (SEQ ID NO: 2119)
                3'-CUCAUAAGGUAAAAAUGAUUUCGUCAC-5'      (SEQ ID NO: 583)
TTR-662 Target: 5'-GAGTATTCCATTTTTACTAAAGCAGTG-3'      (SEQ ID NO: 967)

5'-AGUAUUCCAUUUUUACUAAAGCAGUGU-3'      (SEQ ID NO: 2120)
                3'-UCAUAAGGUAAAAAUGAUUUCGUCACA-5'      (SEQ ID NO: 584)
TTR-663 Target: 5'-AGTATTCCATTTTTACTAAAGCAGTGT-3'      (SEQ ID NO: 968)
```

TABLE 5-continued

Selected Human Anti-Transthyretin "Blunt/Blunt" DsiRNAs

| | | |
|---|---|---|
| TTR-664 Target: | 5'-GUAUUCCAUUUUUACUAAAGCAGUGUU-3'<br>3'-CAUAAGGUAAAAAUGAUUUCGUCACAA-5'<br>5'-GTATTCCATTTTTACTAAAGCAGTGTT-3' | (SEQ ID NO: 2121)<br>(SEQ ID NO: 585)<br>(SEQ ID NO: 969) |
| TTR-665 Target: | 5'-UAUUCCAUUUUUACUAAAGCAGUGUUU-3'<br>3'-AUAAGGUAAAAAUGAUUUCGUCACAAA-5'<br>5'-TATTCCATTTTTACTAAAGCAGTGTTT-3' | (SEQ ID NO: 2122)<br>(SEQ ID NO: 586)<br>(SEQ ID NO: 970) |
| TTR-666 Target: | 5'-AUUCCAUUUUUACUAAAGCAGUGUUUU-3'<br>3'-UAAGGUAAAAAUGAUUUCGUCACAAAA-5'<br>5'-ATTCCATTTTTACTAAAGCAGTGTTTT-3' | (SEQ ID NO: 2123)<br>(SEQ ID NO: 587)<br>(SEQ ID NO: 971) |
| TTR-667 Target: | 5'-UUCCAUUUUUACUAAAGCAGUGUUUUC-3'<br>3'-AAGGUAAAAAUGAUUUCGUCACAAAAG-5'<br>5'-TTCCATTTTTACTAAAGCAGTGTTTTC-3' | (SEQ ID NO: 2124)<br>(SEQ ID NO: 588)<br>(SEQ ID NO: 972) |
| TTR-668 Target: | 5'-UCCAUUUUUACUAAAGCAGUGUUUUCA-3'<br>3'-AGGUAAAAAUGAUUUCGUCACAAAAGU-5'<br>5'-TCCATTTTTACTAAAGCAGTGTTTTCA-3' | (SEQ ID NO: 2125)<br>(SEQ ID NO: 589)<br>(SEQ ID NO: 973) |
| TTR-669 Target: | 5'-CCAUUUUUACUAAAGCAGUGUUUUCAC-3'<br>3'-GGUAAAAAUGAUUUCGUCACAAAAGUG-5'<br>5'-CCATTTTTACTAAAGCAGTGTTTTCAC-3' | (SEQ ID NO: 2126)<br>(SEQ ID NO: 590)<br>(SEQ ID NO: 974) |
| TTR-670 Target: | 5'-CAUUUUUACUAAAGCAGUGUUUUCACC-3'<br>3'-GUAAAAAUGAUUUCGUCACAAAAGUGG-5'<br>5'-CATTTTTACTAAAGCAGTGTTTTCACC-3' | (SEQ ID NO: 2127)<br>(SEQ ID NO: 591)<br>(SEQ ID NO: 975) |
| TTR-671 Target: | 5'-AUUUUUACUAAAGCAGUGUUUUCACCU-3'<br>3'-UAAAAAUGAUUUCGUCACAAAAGUGGA-5'<br>5'-ATTTTTACTAAAGCAGTGTTTTCACCT-3' | (SEQ ID NO: 2128)<br>(SEQ ID NO: 592)<br>(SEQ ID NO: 976) |
| TTR-672 Target: | 5'-UUUUUACUAAAGCAGUGUUUUCACCUC-3'<br>3'-AAAAAUGAUUUCGUCACAAAAGUGGAG-5'<br>5'-TTTTTACTAAAGCAGTGTTTTCACCTC-3' | (SEQ ID NO: 2129)<br>(SEQ ID NO: 593)<br>(SEQ ID NO: 977) |
| TTR-673 Target: | 5'-UUUUACUAAAGCAGUGUUUUCACCUCA-3'<br>3'-AAAAUGAUUUCGUCACAAAAGUGGAGU-5'<br>5'-TTTTACTAAAGCAGTGTTTTCACCTCA-3' | (SEQ ID NO: 2130)<br>(SEQ ID NO: 594)<br>(SEQ ID NO: 978) |
| TTR-674 Target: | 5'-UUUACUAAAGCAGUGUUUUCACCUCAU-3'<br>3'-AAAUGAUUUCGUCACAAAAGUGGAGUA-5'<br>5'-TTTACTAAAGCAGTGTTTTCACCTCAT-3' | (SEQ ID NO: 2131)<br>(SEQ ID NO: 595)<br>(SEQ ID NO: 979) |
| TTR-675 Target: | 5'-UUACUAAAGCAGUGUUUUCACCUCAUA-3'<br>3'-AAUGAUUUCGUCACAAAAGUGGAGUAU-5'<br>5'-TTACTAAAGCAGTGTTTTCACCTCATA-3' | (SEQ ID NO: 2132)<br>(SEQ ID NO: 596)<br>(SEQ ID NO: 980) |
| TTR-676 Target: | 5'-UACUAAAGCAGUGUUUUCACCUCAUAU-3'<br>3'-AUGAUUUCGUCACAAAAGUGGAGUAUA-5'<br>5'-TACTAAAGCAGTGTTTTCACCTCATAT-3' | (SEQ ID NO: 2133)<br>(SEQ ID NO: 597)<br>(SEQ ID NO: 981) |
| TTR-677 Target: | 5'-ACUAAAGCAGUGUUUUCACCUCAUAUG-3'<br>3'-UGAUUUCGUCACAAAAGUGGAGUAUAC-5'<br>5'-ACTAAAGCAGTGTTTTCACCTCATATG-3' | (SEQ ID NO: 2134)<br>(SEQ ID NO: 598)<br>(SEQ ID NO: 982) |
| TTR-678 Target: | 5'-CUAAAGCAGUGUUUUCACCUCAUAUGC-3'<br>3'-GAUUUCGUCACAAAAGUGGAGUAUACG-5'<br>5'-CTAAAGCAGTGTTTTCACCTCATATGC-3' | (SEQ ID NO: 2135)<br>(SEQ ID NO: 599)<br>(SEQ ID NO: 983) |
| TTR-679 Target: | 5'-UAAAGCAGUGUUUUCACCUCAUAUGCU-3'<br>3'-AUUUCGUCACAAAAGUGGAGUAUACGA-5'<br>5'-TAAAGCAGTGTTTTCACCTCATATGCT-3' | (SEQ ID NO: 2136)<br>(SEQ ID NO: 600)<br>(SEQ ID NO: 984) |
| TTR-680 Target: | 5'-AAAGCAGUGUUUUCACCUCAUAUGCUA-3'<br>3'-UUUCGUCACAAAAGUGGAGUAUACGAU-5'<br>5'-AAAGCAGTGTTTTCACCTCATATGCTA-3' | (SEQ ID NO: 2137)<br>(SEQ ID NO: 601)<br>(SEQ ID NO: 985) |
| TTR-681 Target: | 5'-AAGCAGUGUUUUCACCUCAUAUGCUAU-3'<br>3'-UUCGUCACAAAAGUGGAGUAUACGAUA-5'<br>5'-AAGCAGTGTTTTCACCTCATATGCTAT-3' | (SEQ ID NO: 2138)<br>(SEQ ID NO: 602)<br>(SEQ ID NO: 986) |
| TTR-682 Target: | 5'-AGCAGUGUUUUCACCUCAUAUGCUAUG-3'<br>3'-UCGUCACAAAAGUGGAGUAUACGAUAC-5'<br>5'-AGCAGTGTTTTCACCTCATATGCTATG-3' | (SEQ ID NO: 2139)<br>(SEQ ID NO: 603)<br>(SEQ ID NO: 987) |

TABLE 5-continued

Selected Human Anti-Transthyretin "Blunt/Blunt" DsiRNAs

| | | | |
|---|---|---|---|
| TTR-683 Target: | 5'-GCAGUGUUUUCACCUCAUAUGCUAUGU-3'<br>3'-CGUCACAAAAGUGGAGUAUACGAUACA-5'<br>5'-GCAGTGTTTTCACCTCATATGCTATGT-3' | (SEQ ID NO: 2140)<br>(SEQ ID NO: 604)<br>(SEQ ID NO: 988) | |
| TTR-684 Target: | 5'-CAGUGUUUUCACCUCAUAUGCUAUGUU-3'<br>3'-GUCACAAAAGUGGAGUAUACGAUACAA-5'<br>5'-CAGTGTTTTCACCTCATATGCTATGTT-3' | (SEQ ID NO: 2141)<br>(SEQ ID NO: 605)<br>(SEQ ID NO: 989) | |
| TTR-685 Target: | 5'-AGUGUUUUCACCUCAUAUGCUAUGUUA-3'<br>3'-UCACAAAAGUGGAGUAUACGAUACAAU-5'<br>5'-AGTGTTTTCACCTCATATGCTATGTTA-3' | (SEQ ID NO: 2142)<br>(SEQ ID NO: 606)<br>(SEQ ID NO: 990) | |
| TTR-686 Target: | 5'-GUGUUUUCACCUCAUAUGCUAUGUUAG-3'<br>3'-CACAAAAGUGGAGUAUACGAUACAAUC-5'<br>5'-GTGTTTTCACCTCATATGCTATGTTAG-3' | (SEQ ID NO: 2143)<br>(SEQ ID NO: 607)<br>(SEQ ID NO: 991) | |
| TTR-687 Target: | 5'-UGUUUUCACCUCAUAUGCUAUGUUAGA-3'<br>3'-ACAAAAGUGGAGUAUACGAUACAAUCU-5'<br>5'-TGTTTTCACCTCATATGCTATGTTAGA-3' | (SEQ ID NO: 2144)<br>(SEQ ID NO: 608)<br>(SEQ ID NO: 992) | |
| TTR-688 Target: | 5'-GUUUUCACCUCAUAUGCUAUGUUAGAA-3'<br>3'-CAAAAGUGGAGUAUACGAUACAAUCUU-5'<br>5'-GTTTTCACCTCATATGCTATGTTAGAA-3' | (SEQ ID NO: 2145)<br>(SEQ ID NO: 609)<br>(SEQ ID NO: 993) | |
| TTR-689 Target: | 5'-UUUUCACCUCAUAUGCUAUGUUAGAAG-3'<br>3'-AAAAGUGGAGUAUACGAUACAAUCUUC-5'<br>5'-TTTTCACCTCATATGCTATGTTAGAAG-3' | (SEQ ID NO: 2146)<br>(SEQ ID NO: 610)<br>(SEQ ID NO: 994) | |
| TTR-690 Target: | 5'-UUUCACCUCAUAUGCUAUGUUAGAAGU-3'<br>3'-AAAGUGGAGUAUACGAUACAAUCUUCA-5'<br>5'-TTTCACCTCATATGCTATGTTAGAAGT-3' | (SEQ ID NO: 2147)<br>(SEQ ID NO: 611)<br>(SEQ ID NO: 995) | |
| TTR-691 Target: | 5'-UUCACCUCAUAUGCUAUGUUAGAAGUC-3'<br>3'-AAGUGGAGUAUACGAUACAAUCUUCAG-5'<br>5'-TTCACCTCATATGCTATGTTAGAAGTC-3' | (SEQ ID NO: 2148)<br>(SEQ ID NO: 612)<br>(SEQ ID NO: 996) | |
| TTR-692 Target: | 5'-UCACCUCAUAUGCUAUGUUAGAAGUCC-3'<br>3'-AGUGGAGUAUACGAUACAAUCUUCAGG-5'<br>5'-TCACCTCATATGCTATGTTAGAAGTCC-3' | (SEQ ID NO: 2149)<br>(SEQ ID NO: 613)<br>(SEQ ID NO: 997) | |
| TTR-693 Target: | 5'-CACCUCAUAUGCUAUGUUAGAAGUCCA-3'<br>3'-GUGGAGUAUACGAUACAAUCUUCAGGU-5'<br>5'-CACCTCATATGCTATGTTAGAAGTCCA-3' | (SEQ ID NO: 2150)<br>(SEQ ID NO: 614)<br>(SEQ ID NO: 998) | |
| TTR-694 Target: | 5'-ACCUCAUAUGCUAUGUUAGAAGUCCAG-3'<br>3'-UGGAGUAUACGAUACAAUCUUCAGGUC-5'<br>5'-ACCTCATATGCTATGTTAGAAGTCCAG-3' | (SEQ ID NO: 2151)<br>(SEQ ID NO: 615)<br>(SEQ ID NO: 999) | |
| TTR-695 Target: | 5'-CCUCAUAUGCUAUGUUAGAAGUCCAGG-3'<br>3'-GGAGUAUACGAUACAAUCUUCAGGUCC-5'<br>5'-CCTCATATGCTATGTTAGAAGTCCAGG-3' | (SEQ ID NO: 2152)<br>(SEQ ID NO: 616)<br>(SEQ ID NO: 1000) | |
| TTR-696 Target: | 5'-CUCAUAUGCUAUGUUAGAAGUCCAGGC-3'<br>3'-GAGUAUACGAUACAAUCUUCAGGUCCG-5'<br>5'-CTCATATGCTATGTTAGAAGTCCAGGC-3' | (SEQ ID NO: 2153)<br>(SEQ ID NO: 617)<br>(SEQ ID NO: 1001) | |
| TTR-697 Target: | 5'-UCAUAUGCUAUGUUAGAAGUCCAGGCA-3'<br>3'-AGUAUACGAUACAAUCUUCAGGUCCGU-5'<br>5'-TCATATGCTATGTTAGAAGTCCAGGCA-3' | (SEQ ID NO: 2154)<br>(SEQ ID NO: 618)<br>(SEQ ID NO: 1002) | |
| TTR-698 Target: | 5'-CAUAUGCUAUGUUAGAAGUCCAGGCAG-3'<br>3'-GUAUACGAUACAAUCUUCAGGUCCGUC-5'<br>5'-CATATGCTATGTTAGAAGTCCAGGCAG-3' | (SEQ ID NO: 2155)<br>(SEQ ID NO: 619)<br>(SEQ ID NO: 1003) | |
| TTR-699 Target: | 5'-AUAUGCUAUGUUAGAAGUCCAGGCAGA-3'<br>3'-UAUACGAUACAAUCUUCAGGUCCGUCU-5'<br>5'-ATATGCTATGTTAGAAGTCCAGGCAGA-3' | (SEQ ID NO: 2156)<br>(SEQ ID NO: 620)<br>(SEQ ID NO: 1004) | |
| TTR-702 Target: | 5'-UGCUAUGUUAGAAGUCCAGGCAGAGAC-3'<br>3'-ACGAUACAAUCUUCAGGUCCGUCUCUG-5'<br>5'-TGCTATGTTAGAAGTCCAGGCAGAGAC-3' | (SEQ ID NO: 2157)<br>(SEQ ID NO: 621)<br>(SEQ ID NO: 1005) | |
| TTR-704 Target: | 5'-CUAUGUUAGAAGUCCAGGCAGAGACAA-3'<br>3'-GAUACAAUCUUCAGGUCCGUCUCUGUU-5'<br>5'-CTATGTTAGAAGTCCAGGCAGAGACAA-3' | (SEQ ID NO: 2158)<br>(SEQ ID NO: 622)<br>(SEQ ID NO: 1006) | |

TABLE 5-continued

Selected Human Anti-Transthyretin "Blunt/Blunt" DsiRNAs

| | | |
|---|---|---|
| TTR-705 Target: | 5'-UAUGUUAGAAGUCCAGGCAGAGACAAU-3'<br>3'-AUACAAUCUUCAGGUCCGUCUCUGUUA-5'<br>5'-TATGTTAGAAGTCCAGGCAGAGACAAT-3' | (SEQ ID NO: 2159)<br>(SEQ ID NO: 623)<br>(SEQ ID NO: 1007) |
| TTR-706 Target: | 5'-AUGUUAGAAGUCCAGGCAGAGACAAUA-3'<br>3'-UACAAUCUUCAGGUCCGUCUCUGUUAU-5'<br>5'-ATGTTAGAAGTCCAGGCAGAGACAATA-3' | (SEQ ID NO: 2160)<br>(SEQ ID NO: 624)<br>(SEQ ID NO: 1008) |
| TTR-707 Target: | 5'-UGUUAGAAGUCCAGGCAGAGACAAUAA-3'<br>3'-ACAAUCUUCAGGUCCGUCUCUGUUAUU-5'<br>5'-TGTTAGAAGTCCAGGCAGAGACAATAA-3' | (SEQ ID NO: 2161)<br>(SEQ ID NO: 625)<br>(SEQ ID NO: 1009) |
| TTR-708 Target: | 5'-GUUAGAAGUCCAGGCAGAGACAAUAAA-3'<br>3'-CAAUCUUCAGGUCCGUCUCUGUUAUUU-5'<br>5'-GTTAGAAGTCCAGGCAGAGACAATAAA-3' | (SEQ ID NO: 2162)<br>(SEQ ID NO: 626)<br>(SEQ ID NO: 1010) |
| TTR-709 Target: | 5'-UUAGAAGUCCAGGCAGAGACAAUAAAA-3'<br>3'-AAUCUUCAGGUCCGUCUCUGUUAUUUU-5'<br>5'-TTAGAAGTCCAGGCAGAGACAATAAAA-3' | (SEQ ID NO: 2163)<br>(SEQ ID NO: 627)<br>(SEQ ID NO: 1011) |
| TTR-710 Target: | 5'-UAGAAGUCCAGGCAGAGACAAUAAAAC-3'<br>3'-AUCUUCAGGUCCGUCUCUGUUAUUUUG-5'<br>5'-TAGAAGTCCAGGCAGAGACAATAAAAC-3' | (SEQ ID NO: 2164)<br>(SEQ ID NO: 628)<br>(SEQ ID NO: 1012) |
| TTR-711 Target: | 5'-AGAAGUCCAGGCAGAGACAAUAAAACA-3'<br>3'-UCUUCAGGUCCGUCUCUGUUAUUUUGU-5'<br>5'-AGAAGTCCAGGCAGAGACAATAAAACA-3' | (SEQ ID NO: 2165)<br>(SEQ ID NO: 629)<br>(SEQ ID NO: 1013) |
| TTR-712 Target: | 5'-GAAGUCCAGGCAGAGACAAUAAAACAU-3'<br>3'-CUUCAGGUCCGUCUCUGUUAUUUUGUA-5'<br>5'-GAAGTCCAGGCAGAGACAATAAAACAT-3' | (SEQ ID NO: 2166)<br>(SEQ ID NO: 630)<br>(SEQ ID NO: 1014) |
| TTR-713 Target: | 5'-AAGUCCAGGCAGAGACAAUAAAACAUU-3'<br>3'-UUCAGGUCCGUCUCUGUUAUUUUGUAA-5'<br>5'-AAGTCCAGGCAGAGACAATAAAACATT-3' | (SEQ ID NO: 2167)<br>(SEQ ID NO: 631)<br>(SEQ ID NO: 1015) |
| TTR-714 Target: | 5'-AGUCCAGGCAGAGACAAUAAAACAUUC-3'<br>3'-UCAGGUCCGUCUCUGUUAUUUUGUAAG-5'<br>5'-AGTCCAGGCAGAGACAATAAAACATTC-3' | (SEQ ID NO: 2168)<br>(SEQ ID NO: 632)<br>(SEQ ID NO: 1016) |
| TTR-716 Target: | 5'-UCCAGGCAGAGACAAUAAAACAUUCCU-3'<br>3'-AGGUCCGUCUCUGUUAUUUUGUAAGGA-5'<br>5'-TCCAGGCAGAGACAATAAAACATTCCT-3' | (SEQ ID NO: 2169)<br>(SEQ ID NO: 633)<br>(SEQ ID NO: 1017) |
| TTR-717 Target: | 5'-CCAGGCAGAGACAAUAAAACAUUCCUG-3'<br>3'-GGUCCGUCUCUGUUAUUUUGUAAGGAC-5'<br>5'-CCAGGCAGAGACAATAAAACATTCCTG-3' | (SEQ ID NO: 2170)<br>(SEQ ID NO: 634)<br>(SEQ ID NO: 1018) |
| TTR-718 Target: | 5'-CAGGCAGAGACAAUAAAACAUUCCUGU-3'<br>3'-GUCCGUCUCUGUUAUUUUGUAAGGACA-5'<br>5'-CAGGCAGAGACAATAAAACATTCCTGT-3' | (SEQ ID NO: 2171)<br>(SEQ ID NO: 635)<br>(SEQ ID NO: 1019) |
| TTR-719 Target: | 5'-AGGCAGAGACAAUAAAACAUUCCUGUG-3'<br>3'-UCCGUCUCUGUUAUUUUGUAAGGACAC-5'<br>5'-AGGCAGAGACAATAAAACATTCCTGTG-3' | (SEQ ID NO: 2172)<br>(SEQ ID NO: 636)<br>(SEQ ID NO: 1020) |
| TTR-720 Target: | 5'-GGCAGAGACAAUAAAACAUUCCUGUGA-3'<br>3'-CCGUCUCUGUUAUUUUGUAAGGACACU-5'<br>5'-GGCAGAGACAATAAAACATTCCTGTGA-3' | (SEQ ID NO: 2173)<br>(SEQ ID NO: 637)<br>(SEQ ID NO: 1021) |
| TTR-721 Target: | 5'-GCAGAGACAAUAAAACAUUCCUGUGAA-3'<br>3'-CGUCUCUGUUAUUUUGUAAGGACACUU-5'<br>5'-GCAGAGACAATAAAACATTCCTGTGAA-3' | (SEQ ID NO: 2174)<br>(SEQ ID NO: 638)<br>(SEQ ID NO: 1022) |
| TTR-722 Target: | 5'-CAGAGACAAUAAAACAUUCCUGUGAAA-3'<br>3'-GUCUCUGUUAUUUUGUAAGGACACUUU-5'<br>5'-CAGAGACAATAAAACATTCCTGTGAAA-3' | (SEQ ID NO: 2175)<br>(SEQ ID NO: 639)<br>(SEQ ID NO: 1023) |
| TTR-723 Target: | 5'-AGAGACAAUAAAACAUUCCUGUGAAAG-3'<br>3'-UCUCUGUUAUUUUGUAAGGACACUUUC-5'<br>5'-AGAGACAATAAAACATTCCTGTGAAAG-3' | (SEQ ID NO: 2176)<br>(SEQ ID NO: 640)<br>(SEQ ID NO: 1024) |
| TTR-724 Target: | 5'-GAGACAAUAAAACAUUCCUGUGAAAGG-3'<br>3'-CUCUGUUAUUUUGUAAGGACACUUUCC-5'<br>5'-GAGACAATAAAACATTCCTGTGAAAGG-3' | (SEQ ID NO: 2177)<br>(SEQ ID NO: 641)<br>(SEQ ID NO: 1025) |

TABLE 5-continued

Selected Human Anti-Transthyretin "Blunt/Blunt" DsiRNAs

```
                5'-AGACAAUAAAACAUUCCUGUGAAAGGC-3'   (SEQ ID NO: 2178)
                3'-UCUGUUAUUUUGUAAGGACACUUUCCG-5'   (SEQ ID NO: 642)
TTR-725 Target: 5'-AGACAATAAAACATTCCTGTGAAAGGC-3'   (SEQ ID NO: 1026)

5'-GACAAUAAAACAUUCCUGUGAAAGGCA-3'   (SEQ ID NO: 2179)
                3'-CUGUUAUUUUGUAAGGACACUUUCCGU-5'   (SEQ ID NO: 643)
TTR-726 Target: 5'-GACAATAAAACATTCCTGTGAAAGGCA-3'   (SEQ ID NO: 1027)

5'-ACAAUAAAACAUUCCUGUGAAAGGCAC-3'   (SEQ ID NO: 2180)
                3'-UGUUAUUUUGUAAGGACACUUUCCGUG-5'   (SEQ ID NO: 644)
TTR-727 Target: 5'-ACAATAAAACATTCCTGTGAAAGGCAC-3'   (SEQ ID NO: 1028)

5'-CAAUAAAACAUUCCUGUGAAAGGCACU-3'   (SEQ ID NO: 2181)
                3'-GUUAUUUUGUAAGGACACUUUCCGUGA-5'   (SEQ ID NO: 645)
TTR-728 Target: 5'-CAATAAAACATTCCTGTGAAAGGCACT-3'   (SEQ ID NO: 1029)

5'-UAAAACAUUCCUGUGAAAGGCACUUUU-3'   (SEQ ID NO: 2182)
                3'-AUUUUGUAAGGACACUUUCCGUGAAAA-5'   (SEQ ID NO: 646)
TTR-731 Target: 5'-TAAAACATTCCTGTGAAAGGCACTTTT-3'   (SEQ ID NO: 1030)

5'-AAAACAUUCCUGUGAAAGGCACUUUUC-3'   (SEQ ID NO: 2183)
                3'-UUUUGUAAGGACACUUUCCGUGAAAAG-5'   (SEQ ID NO: 647)
TTR-732 Target: 5'-AAAACATTCCTGTGAAAGGCACTTTTC-3'   (SEQ ID NO: 1031)

5'-AAACAUUCCUGUGAAAGGCACUUUUCA-3'   (SEQ ID NO: 2184)
                3'-UUUGUAAGGACACUUUCCGUGAAAAGU-5'   (SEQ ID NO: 648)
TTR-733 Target: 5'-AAACATTCCTGTGAAAGGCACTTTTCA-3'   (SEQ ID NO: 1032)

5'-AACAUUCCUGUGAAAGGCACUUUUCAU-3'   (SEQ ID NO: 2185)
                3'-UUGUAAGGACACUUUCCGUGAAAAGUA-5'   (SEQ ID NO: 649)
TTR-734 Target: 5'-AACATTCCTGTGAAAGGCACTTTTCAT-3'   (SEQ ID NO: 1033)

5'-ACAUUCCUGUGAAAGGCACUUUUCAUU-3'   (SEQ ID NO: 2186)
                3'-UGUAAGGACACUUUCCGUGAAAAGUAA-5'   (SEQ ID NO: 650)
TTR-735 Target: 5'-ACATTCCTGTGAAAGGCACTTTTCATT-3'   (SEQ ID NO: 1034)

5'-CAUUCCUGUGAAAGGCACUUUUCAUUC-3'   (SEQ ID NO: 2187)
                3'-GUAAGGACACUUUCCGUGAAAAGUAAG-5'   (SEQ ID NO: 651)
TTR-736 Target: 5'-CATTCCTGTGAAAGGCACTTTTCATTC-3'   (SEQ ID NO: 1035)

5'-UUCCUGUGAAAGGCACUUUUCAUUCCA-3'   (SEQ ID NO: 2188)
                3'-AAGGACACUUUCCGUGAAAAGUAAGGU-5'   (SEQ ID NO: 652)
TTR-738 Target: 5'-TTCCTGTGAAAGGCACTTTTCATTCCA-3'   (SEQ ID NO: 1036)

5'-UCCUGUGAAAGGCACUUUUCAUUCCAC-3'   (SEQ ID NO: 2189)
                3'-AGGACACUUUCCGUGAAAAGUAAGGUG-5'   (SEQ ID NO: 653)
TTR-739 Target: 5'-TCCTGTGAAAGGCACTTTTCATTCCAC-3'   (SEQ ID NO: 1037)

5'-CCUGUGAAAGGCACUUUUCAUUCCACU-3'   (SEQ ID NO: 2190)
                3'-GGACACUUUCCGUGAAAAGUAAGGUGA-5'   (SEQ ID NO: 654)
TTR-740 Target: 5'-CCTGTGAAAGGCACTTTTCATTCCACT-3'   (SEQ ID NO: 1038)

5'-CUGUGAAAGGCACUUUUCAUUCCACUU-3'   (SEQ ID NO: 2191)
                3'-GACACUUUCCGUGAAAAGUAAGGUGAA-5'   (SEQ ID NO: 655)
TTR-741 Target: 5'-CTGTGAAAGGCACTTTTCATTCCACTT-3'   (SEQ ID NO: 1039)

5'-UGUGAAAGGCACUUUUCAUUCCACUUU-3'   (SEQ ID NO: 2192)
                3'-ACACUUUCCGUGAAAAGUAAGGUGAAA-5'   (SEQ ID NO: 656)
TTR-742 Target: 5'-TGTGAAAGGCACTTTTCATTCCACTTT-3'   (SEQ ID NO: 1040)

5'-GUGAAAGGCACUUUUCAUUCCACUUUA-3'   (SEQ ID NO: 2193)
                3'-CACUUUCCGUGAAAAGUAAGGUGAAAU-5'   (SEQ ID NO: 657)
TTR-743 Target: 5'-GTGAAAGGCACTTTTCATTCCACTTTA-3'   (SEQ ID NO: 1041)

5'-UGAAAGGCACUUUUCAUUCCACUUUAA-3'   (SEQ ID NO: 2194)
                3'-ACUUUCCGUGAAAAGUAAGGUGAAAUU-5'   (SEQ ID NO: 658)
TTR-744 Target: 5'-TGAAAGGCACTTTTCATTCCACTTTAA-3'   (SEQ ID NO: 1042)

5'-GAAAGGCACUUUUCAUUCCACUUUAAC-3'   (SEQ ID NO: 2195)
                3'-CUUUCCGUGAAAAGUAAGGUGAAAUUG-5'   (SEQ ID NO: 659)
TTR-745 Target: 5'-GAAAGGCACTTTTCATTCCACTTTAAC-3'   (SEQ ID NO: 1043)

5'-AAAGGCACUUUUCAUUCCACUUUAACU-3'   (SEQ ID NO: 2196)
                3'-UUUCCGUGAAAAGUAAGGUGAAAUUGA-5'   (SEQ ID NO: 660)
TTR-746 Target: 5'-AAAGGCACTTTTCATTCCACTTTAACT-3'   (SEQ ID NO: 1044)
```

TABLE 5-continued

Selected Human Anti-Transthyretin "Blunt/Blunt" DsiRNAs

|  |  |  |  |
|---|---|---|---|
| TTR-747 Target: | 5'-AAGGCACUUUUCAUUCCACUUUAACUU-3'<br>3'-UUCCGUGAAAAGUAAGGUGAAAUUGAA-5'<br>5'-AAGGCACTTTTCATTCCACTTTAACTT-3' | (SEQ ID NO: 2197)<br>(SEQ ID NO: 661)<br>(SEQ ID NO: 1045) | |
| TTR-748 Target: | 5'-AGGCACUUUUCAUUCCACUUUAACUUG-3'<br>3'-UCCGUGAAAAGUAAGGUGAAAUUGAAC-5'<br>5'-AGGCACTTTTCATTCCACTTTAACTTG-3' | (SEQ ID NO: 2198)<br>(SEQ ID NO: 662)<br>(SEQ ID NO: 1046) | |
| TTR-749 Target: | 5'-GGCACUUUUCAUUCCACUUUAACUUGA-3'<br>3'-CCGUGAAAAGUAAGGUGAAAUUGAACU-5'<br>5'-GGCACTTTTCATTCCACTTTAACTTGA-3' | (SEQ ID NO: 2199)<br>(SEQ ID NO: 663)<br>(SEQ ID NO: 1047) | |
| TTR-750 Target: | 5'-GCACUUUUCAUUCCACUUUAACUUGAU-3'<br>3'-CGUGAAAAGUAAGGUGAAAUUGAACUA-5'<br>5'-GCACTTTTCATTCCACTTTAACTTGAT-3' | (SEQ ID NO: 2200)<br>(SEQ ID NO: 664)<br>(SEQ ID NO: 1048) | |
| TTR-751 Target: | 5'-CACUUUUCAUUCCACUUUAACUUGAUU-3'<br>3'-GUGAAAAGUAAGGUGAAAUUGAACUAA-5'<br>5'-CACTTTTCATTCCACTTTAACTTGATT-3' | (SEQ ID NO: 2201)<br>(SEQ ID NO: 665)<br>(SEQ ID NO: 1049) | |
| TTR-752 Target: | 5'-ACUUUUCAUUCCACUUUAACUUGAUUU-3'<br>3'-UGAAAAGUAAGGUGAAAUUGAACUAAA-5'<br>5'-ACTTTTCATTCCACTTTAACTTGATTT-3' | (SEQ ID NO: 2202)<br>(SEQ ID NO: 666)<br>(SEQ ID NO: 1050) | |
| TTR-753 Target: | 5'-CUUUUCAUUCCACUUUAACUUGAUUUU-3'<br>3'-GAAAAGUAAGGUGAAAUUGAACUAAAA-5'<br>5'-CTTTTCATTCCACTTTAACTTGATTTT-3' | (SEQ ID NO: 2203)<br>(SEQ ID NO: 667)<br>(SEQ ID NO: 1051) | |
| TTR-754 Target: | 5'-UUUUCAUUCCACUUUAACUUGAUUUUU-3'<br>3'-AAAAGUAAGGUGAAAUUGAACUAAAAA-5'<br>5'-TTTTCATTCCACTTTAACTTGATTTTT-3' | (SEQ ID NO: 2204)<br>(SEQ ID NO: 668)<br>(SEQ ID NO: 1052) | |
| TTR-755 Target: | 5'-UUUCAUUCCACUUUAACUUGAUUUUUU-3'<br>3'-AAAGUAAGGUGAAAUUGAACUAAAAAA-5'<br>5'-TTTCATTCCACTTTAACTTGATTTTTT-3' | (SEQ ID NO: 2205)<br>(SEQ ID NO: 669)<br>(SEQ ID NO: 1053) | |
| TTR-756 Target: | 5'-UUCAUUCCACUUUAACUUGAUUUUUUA-3'<br>3'-AAGUAAGGUGAAAUUGAACUAAAAAAU-5'<br>5'-TTCATTCCACTTTAACTTGATTTTTTA-3' | (SEQ ID NO: 2206)<br>(SEQ ID NO: 670)<br>(SEQ ID NO: 1054) | |
| TTR-757 Target: | 5'-UCAUUCCACUUUAACUUGAUUUUUUAA-3'<br>3'-AGUAAGGUGAAAUUGAACUAAAAAAUU-5'<br>5'-TCATTCCACTTTAACTTGATTTTTTAA-3' | (SEQ ID NO: 2207)<br>(SEQ ID NO: 671)<br>(SEQ ID NO: 1055) | |
| TTR-758 Target: | 5'-CAUUCCACUUUAACUUGAUUUUUUAAA-3'<br>3'-GUAAGGUGAAAUUGAACUAAAAAAUUU-5'<br>5'-CATTCCACTTTAACTTGATTTTTTAAA-3' | (SEQ ID NO: 2208)<br>(SEQ ID NO: 672)<br>(SEQ ID NO: 1056) | |
| TTR-759 Target: | 5'-AUUCCACUUUAACUUGAUUUUUUAAAU-3'<br>3'-UAAGGUGAAAUUGAACUAAAAAAUUUA-5'<br>5'-ATTCCACTTTAACTTGATTTTTTAAAT-3' | (SEQ ID NO: 2209)<br>(SEQ ID NO: 673)<br>(SEQ ID NO: 1057) | |
| TTR-760 Target: | 5'-UUCCACUUUAACUUGAUUUUUUAAAUU-3'<br>3'-AAGGUGAAAUUGAACUAAAAAAUUUAA-5'<br>5'-TTCCACTTTAACTTGATTTTTTAAATT-3' | (SEQ ID NO: 2210)<br>(SEQ ID NO: 674)<br>(SEQ ID NO: 1058) | |
| TTR-761 Target: | 5'-UCCACUUUAACUUGAUUUUUUAAAUUC-3'<br>3'-AGGUGAAAUUGAACUAAAAAAUUUAAG-5'<br>5'-TCCACTTTAACTTGATTTTTTAAATTC-3' | (SEQ ID NO: 2211)<br>(SEQ ID NO: 675)<br>(SEQ ID NO: 1059) | |
| TTR-762 Target: | 5'-CCACUUUAACUUGAUUUUUUAAAUUCC-3'<br>3'-GGUGAAAUUGAACUAAAAAAUUUAAGG-5'<br>5'-CCACTTTAACTTGATTTTTTAAATTCC-3' | (SEQ ID NO: 2212)<br>(SEQ ID NO: 676)<br>(SEQ ID NO: 1060) | |
| TTR-763 Target: | 5'-CACUUUAACUUGAUUUUUUAAAUUCCC-3'<br>3'-GUGAAAUUGAACUAAAAAAUUUAAGGG-5'<br>5'-CACTTTAACTTGATTTTTTAAATTCCC-3' | (SEQ ID NO: 2213)<br>(SEQ ID NO: 677)<br>(SEQ ID NO: 1061) | |
| TTR-764 Target: | 5'-ACUUUAACUUGAUUUUUUAAAUUCCCU-3'<br>3'-UGAAAUUGAACUAAAAAAUUUAAGGGA-5'<br>5'-ACTTTAACTTGATTTTTTAAATTCCCT-3' | (SEQ ID NO: 2214)<br>(SEQ ID NO: 678)<br>(SEQ ID NO: 1062) | |
| TTR-765 Target: | 5'-CUUUAACUUGAUUUUUUAAAUUCCCUU-3'<br>3'-GAAAUUGAACUAAAAAAUUUAAGGGAA-5'<br>5'-CTTTAACTTGATTTTTTAAATTCCCTT-3' | (SEQ ID NO: 2215)<br>(SEQ ID NO: 679)<br>(SEQ ID NO: 1063) | |

TABLE 5-continued

Selected Human Anti-Transthyretin "Blunt/Blunt" DsiRNAs

```
              5'-UUUAACUUGAUUUUUUAAAUUCCCUUA-3'     (SEQ ID NO: 2216)
              3'-AAAUUGAACUAAAAAAUUUAAGGGAAU-5'    (SEQ ID NO: 680)
TTR-766 Target: 5'-TTTAACTTGATTTTTTAAATTCCCTTA-3'   (SEQ ID NO: 1064)

5'-UUAACUUGAUUUUUUAAAUUCCCUUAU-3'    (SEQ ID NO: 2217)
              3'-AAUUGAACUAAAAAAUUUAAGGGAAUA-5'    (SEQ ID NO: 681)
TTR-767 Target: 5'-TTAACTTGATTTTTTAAATTCCCTTAT-3'   (SEQ ID NO: 1065)

5'-UAACUUGAUUUUUUAAAUUCCCUUAUU-3'    (SEQ ID NO: 2218)
              3'-AUUGAACUAAAAAAUUUAAGGGAAUAA-5'    (SEQ ID NO: 682)
TTR-768 Target: 5'-TAACTTGATTTTTTAAATTCCCTTATT-3'   (SEQ ID NO: 1066)

5'-AACUUGAUUUUUUAAAUUCCCUUAUUG-3'    (SEQ ID NO: 2219)
              3'-UUGAACUAAAAAAUUUAAGGGAAUAAC-5'    (SEQ ID NO: 683)
TTR-769 Target: 5'-AACTTGATTTTTTAAATTCCCTTATTG-3'   (SEQ ID NO: 1067)

5'-ACUUGAUUUUUUAAAUUCCCUUAUUGU-3'    (SEQ ID NO: 2220)
              3'-UGAACUAAAAAAUUUAAGGGAAUAACA-5'    (SEQ ID NO: 684)
TTR-770 Target: 5'-ACTTGATTTTTTAAATTCCCTTATTGT-3'   (SEQ ID NO: 1068)

5'-CUUGAUUUUUUAAAUUCCCUUAUUGUC-3'    (SEQ ID NO: 2221)
              3'-GAACUAAAAAAUUUAAGGGAAUAACAG-5'    (SEQ ID NO: 685)
TTR-771 Target: 5'-CTTGATTTTTTAAATTCCCTTATTGTC-3'   (SEQ ID NO: 1069)

5'-UUGAUUUUUUAAAUUCCCUUAUUGUCC-3'    (SEQ ID NO: 2222)
              3'-AACUAAAAAAUUUAAGGGAAUAACAGG-5'    (SEQ ID NO: 686)
TTR-772 Target: 5'-TTGATTTTTTAAATTCCCTTATTGTCC-3'   (SEQ ID NO: 1070)

5'-UGAUUUUUUAAAUUCCCUUAUUGUCCC-3'    (SEQ ID NO: 2223)
              3'-ACUAAAAAAUUUAAGGGAAUAACAGGG-5'    (SEQ ID NO: 687)
TTR-773 Target: 5'-TGATTTTTTAAATTCCCTTATTGTCCC-3'   (SEQ ID NO: 1071)

5'-AUUUUUUAAAUUCCCUUAUUGUCCCUU-3'    (SEQ ID NO: 2224)
              3'-UAAAAAAUUUAAGGGAAUAACAGGGAA-5'    (SEQ ID NO: 688)
TTR-775 Target: 5'-ATTTTTTAAATTCCCTTATTGTCCCTT-3'   (SEQ ID NO: 1072)

5'-UUAAAUUCCCUUAUUGUCCCUUCCAAA-3'    (SEQ ID NO: 2225)
              3'-AAUUUAAGGGAAUAACAGGGAAGGUUU-5'    (SEQ ID NO: 689)
TTR-780 Target: 5'-TTAAATTCCCTTATTGTCCCTTCCAAA-3'   (SEQ ID NO: 1073)

5'-UAAAUUCCCUUAUUGUCCCUUCCAAAA-3'    (SEQ ID NO: 2226)
              3'-AUUUAAGGGAAUAACAGGGAAGGUUUU-5'    (SEQ ID NO: 690)
TTR-781 Target: 5'-TAAATTCCCTTATTGTCCCTTCCAAAA-3'   (SEQ ID NO: 1074)

5'-AUUCCCUUAUUGUCCCUUCCAAAAAAA-3'    (SEQ ID NO: 2227)
              3'-UAAGGGAAUAACAGGGAAGGUUUUUUU-5'    (SEQ ID NO: 691)
TTR-784 Target: 5'-ATTCCCTTATTGTCCCTTCCAAAAAAA-3'   (SEQ ID NO: 1075)

5'-AAAAAAAGAGAAUCAAAAUUUUACAAA-3'    (SEQ ID NO: 2228)
              3'-UUUUUUUCUCUUAGUUUUAAAAUGUUU-5'    (SEQ ID NO: 692)
TTR-805 Target: 5'-AAAAAAAGAGAATCAAAATTTTACAAA-3'   (SEQ ID NO: 1076)

5'-AAAAAAGAGAAUCAAAAUUUUACAAAG-3'    (SEQ ID NO: 2229)
              3'-UUUUUUCUCUUAGUUUUAAAAUGUUUC-5'    (SEQ ID NO: 693)
TTR-806 Target: 5'-AAAAAAGAGAATCAAAATTTTACAAAG-3'   (SEQ ID NO: 1077)

5'-AAAAAGAGAAUCAAAAUUUUACAAAGA-3'    (SEQ ID NO: 2230)
              3'-UUUUUCUCUUAGUUUUAAAAUGUUUCU-5'    (SEQ ID NO: 694)
TTR-807 Target: 5'-AAAAAGAGAATCAAAATTTTACAAAGA-3'   (SEQ ID NO: 1078)

5'-AAAAGAGAAUCAAAAUUUUACAAAGAA-3'    (SEQ ID NO: 2231)
              3'-UUUUCUCUUAGUUUUAAAAUGUUUCUU-5'    (SEQ ID NO: 695)
TTR-808 Target: 5'-AAAAGAGAATCAAAATTTTACAAAGAA-3'   (SEQ ID NO: 1079)

5'-AAAGAGAAUCAAAAUUUUACAAAGAAU-3'    (SEQ ID NO: 2232)
              3'-UUUCUCUUAGUUUUAAAAUGUUUCUUA-5'    (SEQ ID NO: 696)
TTR-809 Target: 5'-AAAGAGAATCAAAATTTTACAAAGAAT-3'   (SEQ ID NO: 1080)

5'-AAGAGAAUCAAAAUUUUACAAAGAAUC-3'    (SEQ ID NO: 2233)
              3'-UUCUCUUAGUUUUAAAAUGUUUCUUAG-5'    (SEQ ID NO: 697)
TTR-810 Target: 5'-AAGAGAATCAAAATTTTACAAAGAATC-3'   (SEQ ID NO: 1081)

5'-AGAGAAUCAAAAUUUUACAAAGAAUCA-3'    (SEQ ID NO: 2234)
              3'-UCUCUUAGUUUUAAAAUGUUUCUUAGU-5'    (SEQ ID NO: 698)
TTR-811 Target: 5'-AGAGAATCAAAATTTTACAAAGAATCA-3'   (SEQ ID NO: 1082)
```

TABLE 5-continued

Selected Human Anti-Transthyretin "Blunt/Blunt" DsiRNAs

|  |  |  |  |
|---|---|---|---|
| TTR-812 Target: | 5'-GAGAAUCAAAAUUUUACAAAGAAUCAA-3'<br>3'-CUCUUAGUUUUAAAAUGUUUCUUAGUU-5'<br>5'-GAGAATCAAAATTTTACAAAGAATCAA-3' | (SEQ ID NO: 2235)<br>(SEQ ID NO: 699)<br>(SEQ ID NO: 1083) |  |
| TTR-813 Target: | 5'-AGAAUCAAAAUUUUACAAAGAAUCAAA-3'<br>3'-UCUUAGUUUUAAAAUGUUUCUUAGUUU-5'<br>5'-AGAATCAAAATTTTACAAAGAATCAAA-3' | (SEQ ID NO: 2236)<br>(SEQ ID NO: 700)<br>(SEQ ID NO: 1084) |  |
| TTR-814 Target: | 5'-GAAUCAAAAUUUUACAAAGAAUCAAAG-3'<br>3'-CUUAGUUUUAAAAUGUUUCUUAGUUUC-5'<br>5'-GAATCAAAATTTTACAAAGAATCAAAG-3' | (SEQ ID NO: 2237)<br>(SEQ ID NO: 701)<br>(SEQ ID NO: 1085) |  |
| TTR-815 Target: | 5'-AAUCAAAAUUUUACAAAGAAUCAAAGG-3'<br>3'-UUAGUUUUAAAAUGUUUCUUAGUUUCC-5'<br>5'-AATCAAAATTTTACAAAGAATCAAAGG-3' | (SEQ ID NO: 2238)<br>(SEQ ID NO: 702)<br>(SEQ ID NO: 1086) |  |
| TTR-816 Target: | 5'-AUCAAAAUUUUACAAAGAAUCAAAGGA-3'<br>3'-UAGUUUUAAAAUGUUUCUUAGUUUCCU-5'<br>5'-ATCAAAATTTTACAAAGAATCAAAGGA-3' | (SEQ ID NO: 2239)<br>(SEQ ID NO: 703)<br>(SEQ ID NO: 1087) |  |
| TTR-817 Target: | 5'-UCAAAAUUUUACAAAGAAUCAAAGGAA-3'<br>3'-AGUUUUAAAAUGUUUCUUAGUUUCCUU-5'<br>5'-TCAAAATTTTACAAAGAATCAAAGGAA-3' | (SEQ ID NO: 2240)<br>(SEQ ID NO: 704)<br>(SEQ ID NO: 1088) |  |
| TTR-818 Target: | 5'-CAAAAUUUUACAAAGAAUCAAAGGAAU-3'<br>3'-GUUUUAAAAUGUUUCUUAGUUUCCUUA-5'<br>5'-CAAAATTTTACAAAGAATCAAAGGAAT-3' | (SEQ ID NO: 2241)<br>(SEQ ID NO: 705)<br>(SEQ ID NO: 1089) |  |
| TTR-819 Target: | 5'-AAAAUUUUACAAAGAAUCAAAGGAAUU-3'<br>3'-UUUUAAAAUGUUUCUUAGUUUCCUUAA-5'<br>5'-AAAATTTTACAAAGAATCAAAGGAATT-3' | (SEQ ID NO: 2242)<br>(SEQ ID NO: 706)<br>(SEQ ID NO: 1090) |  |
| TTR-821 Target: | 5'-AAUUUUACAAAGAAUCAAAGGAAUUCU-3'<br>3'-UUAAAAUGUUUCUUAGUUUCCUUAAGA-5'<br>5'-AATTTTACAAAGAATCAAAGGAATTCT-3' | (SEQ ID NO: 2243)<br>(SEQ ID NO: 707)<br>(SEQ ID NO: 1091) |  |
| TTR-822 Target: | 5'-AUUUUACAAAGAAUCAAAGGAAUUCUA-3'<br>3'-UAAAAUGUUUCUUAGUUUCCUUAAGAU-5'<br>5'-ATTTTACAAAGAATCAAAGGAATTCTA-3' | (SEQ ID NO: 2244)<br>(SEQ ID NO: 708)<br>(SEQ ID NO: 1092) |  |
| TTR-823 Target: | 5'-UUUUACAAAGAAUCAAAGGAAUUCUAG-3'<br>3'-AAAAUGUUUCUUAGUUUCCUUAAGAUC-5'<br>5'-TTTTACAAAGAATCAAAGGAATTCTAG-3' | (SEQ ID NO: 2245)<br>(SEQ ID NO: 709)<br>(SEQ ID NO: 1093) |  |
| TTR-824 Target: | 5'-UUUACAAAGAAUCAAAGGAAUUCUAGA-3'<br>3'-AAAUGUUUCUUAGUUUCCUUAAGAUCU-5'<br>5'-TTTACAAAGAATCAAAGGAATTCTAGA-3' | (SEQ ID NO: 2246)<br>(SEQ ID NO: 710)<br>(SEQ ID NO: 1094) |  |
| TTR-825 Target: | 5'-UUACAAAGAAUCAAAGGAAUUCUAGAA-3'<br>3'-AAUGUUUCUUAGUUUCCUUAAGAUCUU-5'<br>5'-TTACAAAGAATCAAAGGAATTCTAGAA-3' | (SEQ ID NO: 2247)<br>(SEQ ID NO: 711)<br>(SEQ ID NO: 1095) |  |
| TTR-826 Target: | 5'-UACAAAGAAUCAAAGGAAUUCUAGAAA-3'<br>3'-AUGUUUCUUAGUUUCCUUAAGAUCUUU-5'<br>5'-TACAAAGAATCAAAGGAATTCTAGAAA-3' | (SEQ ID NO: 2248)<br>(SEQ ID NO: 712)<br>(SEQ ID NO: 1096) |  |
| TTR-827 Target: | 5'-ACAAAGAAUCAAAGGAAUUCUAGAAAG-3'<br>3'-UGUUUCUUAGUUUCCUUAAGAUCUUUC-5'<br>5'-ACAAAGAATCAAAGGAATTCTAGAAAG-3' | (SEQ ID NO: 2249)<br>(SEQ ID NO: 713)<br>(SEQ ID NO: 1097) |  |
| TTR-828 Target: | 5'-CAAAGAAUCAAAGGAAUUCUAGAAAGU-3'<br>3'-GUUUCUUAGUUUCCUUAAGAUCUUUCA-5'<br>5'-CAAAGAATCAAAGGAATTCTAGAAAGT-3' | (SEQ ID NO: 2250)<br>(SEQ ID NO: 714)<br>(SEQ ID NO: 1098) |  |
| TTR-829 Target: | 5'-AAAGAAUCAAAGGAAUUCUAGAAAGUA-3'<br>3'-UUUCUUAGUUUCCUUAAGAUCUUUCAU-5'<br>5'-AAAGAATCAAAGGAATTCTAGAAAGTA-3' | (SEQ ID NO: 2251)<br>(SEQ ID NO: 715)<br>(SEQ ID NO: 1099) |  |
| TTR-830 Target: | 5'-AAGAAUCAAAGGAAUUCUAGAAAGUAU-3'<br>3'-UUCUUAGUUUCCUUAAGAUCUUUCAUA-5'<br>5'-AAGAATCAAAGGAATTCTAGAAAGTAT-3' | (SEQ ID NO: 2252)<br>(SEQ ID NO: 716)<br>(SEQ ID NO: 1100) |  |
| TTR-831 Target: | 5'-AGAAUCAAAGGAAUUCUAGAAAGUAUC-3'<br>3'-UCUUAGUUUCCUUAAGAUCUUUCAUAG-5'<br>5'-AGAATCAAAGGAATTCTAGAAAGTATC-3' | (SEQ ID NO: 2253)<br>(SEQ ID NO: 717)<br>(SEQ ID NO: 1101) |  |

TABLE 5-continued

Selected Human Anti-Transthyretin "Blunt/Blunt" DsiRNAs

|  |  |  |
|---|---|---|
| TTR-832 Target: | 5'-GAAUCAAAGGAAUUCUAGAAAGUAUCU-3'<br>3'-CUUAGUUUCCUUAAGAUCUUUCAUAGA-5'<br>5'-GAATCAAAGGAATTCTAGAAAGTATCT-3' | (SEQ ID NO: 2254)<br>(SEQ ID NO: 718)<br>(SEQ ID NO: 1102) |
| TTR-833 Target: | 5'-AAUCAAAGGAAUUCUAGAAAGUAUCUG-3'<br>3'-UUAGUUUCCUUAAGAUCUUUCAUAGAC-5'<br>5'-AATCAAAGGAATTCTAGAAAGTATCTG-3' | (SEQ ID NO: 2255)<br>(SEQ ID NO: 719)<br>(SEQ ID NO: 1103) |
| TTR-834 Target: | 5'-AUCAAAGGAAUUCUAGAAAGUAUCUGG-3'<br>3'-UAGUUUCCUUAAGAUCUUUCAUAGACC-5'<br>5'-ATCAAAGGAATTCTAGAAAGTATCTGG-3' | (SEQ ID NO: 2256)<br>(SEQ ID NO: 720)<br>(SEQ ID NO: 1104) |
| TTR-835 Target: | 5'-UCAAAGGAAUUCUAGAAAGUAUCUGGG-3'<br>3'-AGUUUCCUUAAGAUCUUUCAUAGACCC-5'<br>5'-TCAAAGGAATTCTAGAAAGTATCTGGG-3' | (SEQ ID NO: 2257)<br>(SEQ ID NO: 721)<br>(SEQ ID NO: 1105) |
| TTR-869 Target: | 5'-CUAGGAGAGAUCCAAAUUUCCAUUGUC-3'<br>3'-GAUCCUCUCUAGGUUUAAAGGUAACAG-5'<br>5'-CTAGGAGAGATCCAAATTTCCATTGTC-3' | (SEQ ID NO: 2258)<br>(SEQ ID NO: 722)<br>(SEQ ID NO: 1106) |
| TTR-870 Target: | 5'-UAGGAGAGAUCCAAAUUUCCAUUGUCU-3'<br>3'-AUCCUCUCUAGGUUUAAAGGUAACAGA-5'<br>5'-TAGGAGAGATCCAAATTTCCATTGTCT-3' | (SEQ ID NO: 2259)<br>(SEQ ID NO: 723)<br>(SEQ ID NO: 1107) |
| TTR-873 Target: | 5'-GAGAGAUCCAAAUUUCCAUUGUCUUGC-3'<br>3'-CUCUCUAGGUUUAAAGGUAACAGAACG-5'<br>5'-GAGAGATCCAAATTTCCATTGTCTTGC-3' | (SEQ ID NO: 2260)<br>(SEQ ID NO: 724)<br>(SEQ ID NO: 1108) |
| TTR-874 Target: | 5'-AGAGAUCCAAAUUUCCAUUGUCUUGCA-3'<br>3'-UCUCUAGGUUUAAAGGUAACAGAACGU-5'<br>5'-AGAGATCCAAATTTCCATTGTCTTGCA-3' | (SEQ ID NO: 2261)<br>(SEQ ID NO: 725)<br>(SEQ ID NO: 1109) |
| TTR-875 Target: | 5'-GAGAUCCAAAUUUCCAUUGUCUUGCAA-3'<br>3'-CUCUAGGUUUAAAGGUAACAGAACGUU-5'<br>5'-GAGATCCAAATTTCCATTGTCTTGCAA-3' | (SEQ ID NO: 2262)<br>(SEQ ID NO: 726)<br>(SEQ ID NO: 1110) |
| TTR-876 Target: | 5'-AGAUCCAAAUUUCCAUUGUCUUGCAAG-3'<br>3'-UCUAGGUUUAAAGGUAACAGAACGUUC-5'<br>5'-AGATCCAAATTTCCATTGTCTTGCAAG-3' | (SEQ ID NO: 2263)<br>(SEQ ID NO: 727)<br>(SEQ ID NO: 1111) |
| TTR-877 Target: | 5'-GAUCCAAAUUUCCAUUGUCUUGCAAGC-3'<br>3'-CUAGGUUUAAAGGUAACAGAACGUUCG-5'<br>5'-GATCCAAATTTCCATTGTCTTGCAAGC-3' | (SEQ ID NO: 2264)<br>(SEQ ID NO: 728)<br>(SEQ ID NO: 1112) |
| TTR-878 Target: | 5'-AUCCAAAUUUCCAUUGUCUUGCAAGCA-3'<br>3'-UAGGUUUAAAGGUAACAGAACGUUCGU-5'<br>5'-ATCCAAATTTCCATTGTCTTGCAAGCA-3' | (SEQ ID NO: 2265)<br>(SEQ ID NO: 729)<br>(SEQ ID NO: 1113) |
| TTR-879 Target: | 5'-UCCAAAUUUCCAUUGUCUUGCAAGCAA-3'<br>3'-AGGUUUAAAGGUAACAGAACGUUCGUU-5'<br>5'-TCCAAATTTCCATTGTCTTGCAAGCAA-3' | (SEQ ID NO: 2266)<br>(SEQ ID NO: 730)<br>(SEQ ID NO: 1114) |
| TTR-880 Target: | 5'-CCAAAUUUCCAUUGUCUUGCAAGCAAA-3'<br>3'-GGUUUAAAGGUAACAGAACGUUCGUUU-5'<br>5'-CCAAATTTCCATTGTCTTGCAAGCAAA-3' | (SEQ ID NO: 2267)<br>(SEQ ID NO: 731)<br>(SEQ ID NO: 1115) |
| TTR-881 Target: | 5'-CAAAUUUCCAUUGUCUUGCAAGCAAAG-3'<br>3'-GUUUAAAGGUAACAGAACGUUCGUUUC-5'<br>5'-CAAATTTCCATTGTCTTGCAAGCAAAG-3' | (SEQ ID NO: 2268)<br>(SEQ ID NO: 732)<br>(SEQ ID NO: 1116) |
| TTR-882 Target: | 5'-AAAUUUCCAUUGUCUUGCAAGCAAAGC-3'<br>3'-UUUAAAGGUAACAGAACGUUCGUUUCG-5'<br>5'-AAATTTCCATTGTCTTGCAAGCAAAGC-3' | (SEQ ID NO: 2269)<br>(SEQ ID NO: 733)<br>(SEQ ID NO: 1117) |
| TTR-883 Target: | 5'-AAUUUCCAUUGUCUUGCAAGCAAAGCA-3'<br>3'-UUAAAGGUAACAGAACGUUCGUUUCGU-5'<br>5'-AATTTCCATTGTCTTGCAAGCAAAGCA-3' | (SEQ ID NO: 2270)<br>(SEQ ID NO: 734)<br>(SEQ ID NO: 1118) |
| TTR-884 Target: | 5'-AUUUCCAUUGUCUUGCAAGCAAAGCAC-3'<br>3'-UAAAGGUAACAGAACGUUCGUUUCGUG-5'<br>5'-ATTTCCATTGTCTTGCAAGCAAAGCAC-3' | (SEQ ID NO: 2271)<br>(SEQ ID NO: 735)<br>(SEQ ID NO: 1119) |
| TTR-885 Target: | 5'-UUUCCAUUGUCUUGCAAGCAAAGCACG-3'<br>3'-AAAGGUAACAGAACGUUCGUUUCGUGC-5'<br>5'-TTTCCATTGTCTTGCAAGCAAAGCACG-3' | (SEQ ID NO: 2272)<br>(SEQ ID NO: 736)<br>(SEQ ID NO: 1120) |

TABLE 5-continued

Selected Human Anti-Transthyretin "Blunt/Blunt" DsiRNAs

```
                5'-UUCCAUUGUCUUGCAAGCAAAGCACGU-3'    (SEQ ID NO: 2273)
                3'-AAGGUAACAGAACGUUCGUUUCGUGCA-5'    (SEQ ID NO: 737)
TTR-886 Target: 5'-TTCCATTGTCTTGCAAGCAAAGCACGT-3'    (SEQ ID NO: 1121)

5'-UCCAUUGUCUUGCAAGCAAAGCACGUA-3'    (SEQ ID NO: 2274)
                3'-AGGUAACAGAACGUUCGUUUCGUGCAU-5'    (SEQ ID NO: 738)
TTR-887 Target: 5'-TCCATTGTCTTGCAAGCAAAGCACGTA-3'    (SEQ ID NO: 1122)

5'-CCAUUGUCUUGCAAGCAAAGCACGUAU-3'    (SEQ ID NO: 2275)
                3'-GGUAACAGAACGUUCGUUUCGUGCAUA-5'    (SEQ ID NO: 739)
TTR-888 Target: 5'-CCATTGTCTTGCAAGCAAAGCACGTAT-3'    (SEQ ID NO: 1123)

5'-CAUUGUCUUGCAAGCAAAGCACGUAUU-3'    (SEQ ID NO: 2276)
                3'-GUAACAGAACGUUCGUUUCGUGCAUAA-5'    (SEQ ID NO: 740)
TTR-889 Target: 5'-CATTGTCTTGCAAGCAAAGCACGTATT-3'    (SEQ ID NO: 1124)

5'-AUUGUCUUGCAAGCAAAGCACGUAUUA-3'    (SEQ ID NO: 2277)
                3'-UAACAGAACGUUCGUUUCGUGCAUAAU-5'    (SEQ ID NO: 741)
TTR-890 Target: 5'-ATTGTCTTGCAAGCAAAGCACGTATTA-3'    (SEQ ID NO: 1125)

5'-UUGUCUUGCAAGCAAAGCACGUAUUAA-3'    (SEQ ID NO: 2278)
                3'-AACAGAACGUUCGUUUCGUGCAUAAUU-5'    (SEQ ID NO: 742)
TTR-891 Target: 5'-TTGTCTTGCAAGCAAAGCACGTATTAA-3'    (SEQ ID NO: 1126)

5'-UGUCUUGCAAGCAAAGCACGUAUUAAA-3'    (SEQ ID NO: 2279)
                3'-ACAGAACGUUCGUUUCGUGCAUAAUUU-5'    (SEQ ID NO: 743)
TTR-892 Target: 5'-TGTCTTGCAAGCAAAGCACGTATTAAA-3'    (SEQ ID NO: 1127)

5'-GUCUUGCAAGCAAAGCACGUAUUAAAU-3'    (SEQ ID NO: 2280)
                3'-CAGAACGUUCGUUUCGUGCAUAAUUUA-5'    (SEQ ID NO: 744)
TTR-893 Target: 5'-GTCTTGCAAGCAAAGCACGTATTAAAT-3'    (SEQ ID NO: 1128)

5'-UCUUGCAAGCAAAGCACGUAUUAAAUA-3'    (SEQ ID NO: 2281)
                3'-AGAACGUUCGUUUCGUGCAUAAUUUAU-5'    (SEQ ID NO: 745)
TTR-894 Target: 5'-TCTTGCAAGCAAAGCACGTATTAAATA-3'    (SEQ ID NO: 1129)

5'-CUUGCAAGCAAAGCACGUAUUAAAUAU-3'    (SEQ ID NO: 2282)
                3'-GAACGUUCGUUUCGUGCAUAAUUUAUA-5'    (SEQ ID NO: 746)
TTR-895 Target: 5'-CTTGCAAGCAAAGCACGTATTAAATAT-3'    (SEQ ID NO: 1130)

5'-UUGCAAGCAAAGCACGUAUUAAAUAUG-3'    (SEQ ID NO: 2283)
                3'-AACGUUCGUUUCGUGCAUAAUUUAUAC-5'    (SEQ ID NO: 747)
TTR-896 Target: 5'-TTGCAAGCAAAGCACGTATTAAATATG-3'    (SEQ ID NO: 1131)

5'-UGCAAGCAAAGCACGUAUUAAAUAUGA-3'    (SEQ ID NO: 2284)
                3'-ACGUUCGUUUCGUGCAUAAUUUAUACU-5'    (SEQ ID NO: 748)
TTR-897 Target: 5'-TGCAAGCAAAGCACGTATTAAATATGA-3'    (SEQ ID NO: 1132)

5'-GCAAGCAAAGCACGUAUUAAAUAUGAU-3'    (SEQ ID NO: 2285)
                3'-CGUUCGUUUCGUGCAUAAUUUAUACUA-5'    (SEQ ID NO: 749)
TTR-898 Target: 5'-GCAAGCAAAGCACGTATTAAATATGAT-3'    (SEQ ID NO: 1133)

5'-CAAGCAAAGCACGUAUUAAAUAUGAUC-3'    (SEQ ID NO: 2286)
                3'-GUUCGUUUCGUGCAUAAUUUAUACUAG-5'    (SEQ ID NO: 750)
TTR-899 Target: 5'-CAAGCAAAGCACGTATTAAATATGATC-3'    (SEQ ID NO: 1134)

5'-AAGCAAAGCACGUAUUAAAUAUGAUCU-3'    (SEQ ID NO: 2287)
                3'-UUCGUUUCGUGCAUAAUUUAUACUAGA-5'    (SEQ ID NO: 751)
TTR-900 Target: 5'-AAGCAAAGCACGTATTAAATATGATCT-3'    (SEQ ID NO: 1135)

5'-AGCAAAGCACGUAUUAAAUAUGAUCUG-3'    (SEQ ID NO: 2288)
                3'-UCGUUUCGUGCAUAAUUUAUACUAGAC-5'    (SEQ ID NO: 752)
TTR-901 Target: 5'-AGCAAAGCACGTATTAAATATGATCTG-3'    (SEQ ID NO: 1136)

5'-GCAAAGCACGUAUUAAAUAUGAUCUGC-3'    (SEQ ID NO: 2289)
                3'-CGUUUCGUGCAUAAUUUAUACUAGACG-5'    (SEQ ID NO: 753)
TTR-902 Target: 5'-GCAAAGCACGTATTAAATATGATCTGC-3'    (SEQ ID NO: 1137)

5'-CAAAGCACGUAUUAAAUAUGAUCUGCA-3'    (SEQ ID NO: 2290)
                3'-GUUUCGUGCAUAAUUUAUACUAGACGU-5'    (SEQ ID NO: 754)
TTR-903 Target: 5'-CAAAGCACGTATTAAATATGATCTGCA-3'    (SEQ ID NO: 1138)

5'-AAAGCACGUAUUAAAUAUGAUCUGCAG-3'    (SEQ ID NO: 2291)
                3'-UUUCGUGCAUAAUUUAUACUAGACGUC-5'    (SEQ ID NO: 755)
TTR-904 Target: 5'-AAAGCACGTATTAAATATGATCTGCAG-3'    (SEQ ID NO: 1139)
```

TABLE 5-continued

Selected Human Anti-Transthyretin "Blunt/Blunt" DsiRNAs

|  |  |  |
| --- | --- | --- |
| TTR-905 Target: | 5'-AAGCACGUAUUAAAUAUGAUCUGCAGC-3'<br>3'-UUCGUGCAUAAUUUAUACUAGACGUCG-5'<br>5'-AAGCACGTATTAAATATGATCTGCAGC-3' | (SEQ ID NO: 2292)<br>(SEQ ID NO: 756)<br>(SEQ ID NO: 1140) |
| TTR-906 Target: | 5'-AGCACGUAUUAAAUAUGAUCUGCAGCC-3'<br>3'-UCGUGCAUAAUUUAUACUAGACGUCGG-5'<br>5'-AGCACGTATTAAATATGATCTGCAGCC-3' | (SEQ ID NO: 2293)<br>(SEQ ID NO: 757)<br>(SEQ ID NO: 1141) |
| TTR-908 Target: | 5'-CACGUAUUAAAUAUGAUCUGCAGCCAU-3'<br>3'-GUGCAUAAUUUAUACUAGACGUCGGUA-5'<br>5'-CACGTATTAAATATGATCTGCAGCCAT-3' | (SEQ ID NO: 2294)<br>(SEQ ID NO: 758)<br>(SEQ ID NO: 1142) |
| TTR-909 Target: | 5'-ACGUAUUAAAUAUGAUCUGCAGCCAUU-3'<br>3'-UGCAUAAUUUAUACUAGACGUCGGUAA-5'<br>5'-ACGTATTAAATATGATCTGCAGCCATT-3' | (SEQ ID NO: 2295)<br>(SEQ ID NO: 759)<br>(SEQ ID NO: 1143) |
| TTR-911 Target: | 5'-GUAUUAAAUAUGAUCUGCAGCCAUUAA-3'<br>3'-CAUAAUUUAUACUAGACGUCGGUAAUU-5'<br>5'-GTATTAAATATGATCTGCAGCCATTAA-3' | (SEQ ID NO: 2296)<br>(SEQ ID NO: 760)<br>(SEQ ID NO: 1144) |
| TTR-912 Target: | 5'-UAUUAAAUAUGAUCUGCAGCCAUUAAA-3'<br>3'-AUAAUUUAUACUAGACGUCGGUAAUUU-5'<br>5'-TATTAAATATGATCTGCAGCCATTAAA-3' | (SEQ ID NO: 2297)<br>(SEQ ID NO: 761)<br>(SEQ ID NO: 1145) |
| TTR-913 Target: | 5'-AUUAAAUAUGAUCUGCAGCCAUUAAAA-3'<br>3'-UAAUUUAUACUAGACGUCGGUAAUUUU-5'<br>5'-ATTAAATATGATCTGCAGCCATTAAAA-3' | (SEQ ID NO: 2298)<br>(SEQ ID NO: 762)<br>(SEQ ID NO: 1146) |
| TTR-914 Target: | 5'-UUAAAUAUGAUCUGCAGCCAUUAAAAA-3'<br>3'-AAUUUAUACUAGACGUCGGUAAUUUUU-5'<br>5'-TTAAATATGATCTGCAGCCATTAAAAA-3' | (SEQ ID NO: 2299)<br>(SEQ ID NO: 763)<br>(SEQ ID NO: 1147) |
| TTR-915 Target: | 5'-UAAAUAUGAUCUGCAGCCAUUAAAAAG-3'<br>3'-AUUUAUACUAGACGUCGGUAAUUUUUC-5'<br>5'-TAAATATGATCTGCAGCCATTAAAAAG-3' | (SEQ ID NO: 2300)<br>(SEQ ID NO: 764)<br>(SEQ ID NO: 1148) |
| TTR-916 Target: | 5'-AAAUAUGAUCUGCAGCCAUUAAAAAGA-3'<br>3'-UUUAUACUAGACGUCGGUAAUUUUUCU-5'<br>5'-AAATATGATCTGCAGCCATTAAAAAGA-3' | (SEQ ID NO: 2301)<br>(SEQ ID NO: 765)<br>(SEQ ID NO: 1149) |
| TTR-917 Target: | 5'-AAUAUGAUCUGCAGCCAUUAAAAAGAC-3'<br>3'-UUAUACUAGACGUCGGUAAUUUUUCUG-5'<br>5'-AATATGATCTGCAGCCATTAAAAAGAC-3' | (SEQ ID NO: 2302)<br>(SEQ ID NO: 766)<br>(SEQ ID NO: 1150) |
| TTR-918 Target: | 5'-AUAUGAUCUGCAGCCAUUAAAAAGACA-3'<br>3'-UAUACUAGACGUCGGUAAUUUUUCUGU-5'<br>5'-ATATGATCTGCAGCCATTAAAAAGACA-3' | (SEQ ID NO: 2303)<br>(SEQ ID NO: 767)<br>(SEQ ID NO: 1151) |
| TTR-919 Target: | 5'-UAUGAUCUGCAGCCAUUAAAAAGACAC-3'<br>3'-AUACUAGACGUCGGUAAUUUUUCUGUG-5'<br>5'-TATGATCTGCAGCCATTAAAAAGACAC-3' | (SEQ ID NO: 2304)<br>(SEQ ID NO: 768)<br>(SEQ ID NO: 1152) |

TABLE 6

DsiRNA Component 19 Nucleotide Target Sequences in Transthyretin mRNA

| | | |
| --- | --- | --- |
| TTR-27 19 nt Target #1: | 5'-UGACUAAGUCAAUAAUCAG-3' | (SEQ ID NO: 2305) |
| TTR-27 19 nt Target #2: | 5'-UUGACUAAGUCAAUAAUCA-3' | (SEQ ID NO: 2689) |
| TTR-27 19 nt Target #3: | 5'-GUUGACUAAGUCAAUAAUC-3' | (SEQ ID NO: 3073) |
| TTR-28 19 nt Target #1: | 5'-GACUAAGUCAAUAAUCAGA-3' | (SEQ ID NO: 2306) |
| TTR-28 19 nt Target #2: | 5'-UGACUAAGUCAAUAAUCAG-3' | (SEQ ID NO: 2690) |
| TTR-28 19 nt Target #3: | 5'-UUGACUAAGUCAAUAAUCA-3' | (SEQ ID NO: 3074) |
| TTR-29 19 nt Target #1: | 5'-ACUAAGUCAAUAAUCAGAA-3' | (SEQ ID NO: 2307) |
| TTR-29 19 nt Target #2: | 5'-GACUAAGUCAAUAAUCAGA-3' | (SEQ ID NO: 2691) |
| TTR-29 19 nt Target #3: | 5'-UGACUAAGUCAAUAAUCAG-3' | (SEQ ID NO: 3075) |

TABLE 6-continued

DsiRNA Component 19 Nucleotide Target Sequences in Transthyretin mRNA

| | | |
|---|---|---|
| TTR-30 19 nt Target #1: | 5'-CUAAGUCAAUAAUCAGAAU-3' | (SEQ ID NO: 2308) |
| TTR-30 19 nt Target #2: | 5'-ACUAAGUCAAUAAUCAGAA-3' | (SEQ ID NO: 2692) |
| TTR-30 19 nt Target #3: | 5'-GACUAAGUCAAUAAUCAGA-3' | (SEQ ID NO: 3076) |
| TTR-31 19 nt Target #1: | 5'-UAAGUCAAUAAUCAGAAUC-3' | (SEQ ID NO: 2309) |
| TTR-31 19 nt Target #2: | 5'-CUAAGUCAAUAAUCAGAAU-3' | (SEQ ID NO: 2693) |
| TTR-31 19 nt Target #3: | 5'-ACUAAGUCAAUAAUCAGAA-3' | (SEQ ID NO: 3077) |
| TTR-32 19 nt Target #1: | 5'-AAGUCAAUAAUCAGAAUCA-3' | (SEQ ID NO: 2310) |
| TTR-32 19 nt Target #2: | 5'-UAAGUCAAUAAUCAGAAUC-3' | (SEQ ID NO: 2694) |
| TTR-32 19 nt Target #3: | 5'-CUAAGUCAAUAAUCAGAAU-3' | (SEQ ID NO: 3078) |
| TTR-33 19 nt Target #1: | 5'-AGUCAAUAAUCAGAAUCAG-3' | (SEQ ID NO: 2311) |
| TTR-33 19 nt Target #2: | 5'-AAGUCAAUAAUCAGAAUCA-3' | (SEQ ID NO: 2695) |
| TTR-33 19 nt Target #3: | 5'-UAAGUCAAUAAUCAGAAUC-3' | (SEQ ID NO: 3079) |
| TTR-34 19 nt Target #1: | 5'-GUCAAUAAUCAGAAUCAGC-3' | (SEQ ID NO: 2312) |
| TTR-34 19 nt Target #2: | 5'-AGUCAAUAAUCAGAAUCAG-3' | (SEQ ID NO: 2696) |
| TTR-34 19 nt Target #3: | 5'-AAGUCAAUAAUCAGAAUCA-3' | (SEQ ID NO: 3080) |
| TTR-35 19 nt Target #1: | 5'-UCAAUAAUCAGAAUCAGCA-3' | (SEQ ID NO: 2313) |
| TTR-35 19 nt Target #2: | 5'-GUCAAUAAUCAGAAUCAGC-3' | (SEQ ID NO: 2697) |
| TTR-35 19 nt Target #3: | 5'-AGUCAAUAAUCAGAAUCAG-3' | (SEQ ID NO: 3081) |
| TTR-36 19 nt Target #1: | 5'-CAAUAAUCAGAAUCAGCAG-3' | (SEQ ID NO: 2314) |
| TTR-36 19 nt Target #2: | 5'-UCAAUAAUCAGAAUCAGCA-3' | (SEQ ID NO: 2698) |
| TTR-36 19 nt Target #3: | 5'-GUCAAUAAUCAGAAUCAGC-3' | (SEQ ID NO: 3082) |
| TTR-37 19 nt Target #1: | 5'-AAUAAUCAGAAUCAGCAGG-3' | (SEQ ID NO: 2315) |
| TTR-37 19 nt Target #2: | 5'-CAAUAAUCAGAAUCAGCAG-3' | (SEQ ID NO: 2699) |
| TTR-37 19 nt Target #3: | 5'-UCAAUAAUCAGAAUCAGCA-3' | (SEQ ID NO: 3083) |
| TTR-38 19 nt Target #1: | 5'-AUAAUCAGAAUCAGCAGGU-3' | (SEQ ID NO: 2316) |
| TTR-38 19 nt Target #2: | 5'-AAUAAUCAGAAUCAGCAGG-3' | (SEQ ID NO: 2700) |
| TTR-38 19 nt Target #3: | 5'-CAAUAAUCAGAAUCAGCAG-3' | (SEQ ID NO: 3084) |
| TTR-39 19 nt Target #1: | 5'-UAAUCAGAAUCAGCAGGUU-3' | (SEQ ID NO: 2317) |
| TTR-39 19 nt Target #2: | 5'-AUAAUCAGAAUCAGCAGGU-3' | (SEQ ID NO: 2701) |
| TTR-39 19 nt Target #3: | 5'-AAUAAUCAGAAUCAGCAGG-3' | (SEQ ID NO: 3085) |
| TTR-40 19 nt Target #1: | 5'-AAUCAGAAUCAGCAGGUUU-3' | (SEQ ID NO: 2318) |
| TTR-40 19 nt Target #2: | 5'-UAAUCAGAAUCAGCAGGUU-3' | (SEQ ID NO: 2702) |
| TTR-40 19 nt Target #3: | 5'-AUAAUCAGAAUCAGCAGGU-3' | (SEQ ID NO: 3086) |
| TTR-41 19 nt Target #1: | 5'-AUCAGAAUCAGCAGGUUUG-3' | (SEQ ID NO: 2319) |
| TTR-41 19 nt Target #2: | 5'-AAUCAGAAUCAGCAGGUUU-3' | (SEQ ID NO: 2703) |
| TTR-41 19 nt Target #3: | 5'-UAAUCAGAAUCAGCAGGUU-3' | (SEQ ID NO: 3087) |
| TTR-43 19 nt Target #1: | 5'-CAGAAUCAGCAGGUUUGCA-3' | (SEQ ID NO: 2320) |
| TTR-43 19 nt Target #2: | 5'-UCAGAAUCAGCAGGUUUGC-3' | (SEQ ID NO: 2704) |
| TTR-43 19 nt Target #3: | 5'-AUCAGAAUCAGCAGGUUUG-3' | (SEQ ID NO: 3088) |

TABLE 6-continued

DsiRNA Component 19 Nucleotide Target Sequences in Transthyretin mRNA

| | | |
|---|---|---|
| TTR-44 19 nt Target #1: | 5'-AGAAUCAGCAGGUUUGCAG-3' | (SEQ ID NO: 2321) |
| TTR-44 19 nt Target #2: | 5'-CAGAAUCAGCAGGUUUGCA-3' | (SEQ ID NO: 2705) |
| TTR-44 19 nt Target #3: | 5'-UCAGAAUCAGCAGGUUUGC-3' | (SEQ ID NO: 3089) |
| TTR-46 19 nt Target #1: | 5'-AAUCAGCAGGUUUGCAGUC-3' | (SEQ ID NO: 2322) |
| TTR-46 19 nt Target #2: | 5'-GAAUCAGCAGGUUUGCAGU-3' | (SEQ ID NO: 2706) |
| TTR-46 19 nt Target #3: | 5'-AGAAUCAGCAGGUUUGCAG-3' | (SEQ ID NO: 3090) |
| TTR-47 19 nt Target #1: | 5'-AUCAGCAGGUUUGCAGUCA-3' | (SEQ ID NO: 2323) |
| TTR-47 19 nt Target #2: | 5'-AAUCAGCAGGUUUGCAGUC-3' | (SEQ ID NO: 2707) |
| TTR-47 19 nt Target #3: | 5'-GAAUCAGCAGGUUUGCAGU-3' | (SEQ ID NO: 3091) |
| TTR-59 19 nt Target #1: | 5'-GCAGUCAGAUUGGCAGGGA-3' | (SEQ ID NO: 2324) |
| TTR-59 19 nt Target #2: | 5'-UGCAGUCAGAUUGGCAGGG-3' | (SEQ ID NO: 2708) |
| TTR-59 19 nt Target #3: | 5'-UUGCAGUCAGAUUGGCAGG-3' | (SEQ ID NO: 3092) |
| TTR-84 19 nt Target #1: | 5'-GCCUAGCUCAGGAGAAGUG-3' | (SEQ ID NO: 2325) |
| TTR-84 19 nt Target #2: | 5'-AGCCUAGCUCAGGAGAAGU-3' | (SEQ ID NO: 2709) |
| TTR-84 19 nt Target #3: | 5'-CAGCCUAGCUCAGGAGAAG-3' | (SEQ ID NO: 3093) |
| TTR-87 19 nt Target #1: | 5'-UAGCUCAGGAGAAGUGAGU-3' | (SEQ ID NO: 2326) |
| TTR-87 19 nt Target #2: | 5'-CUAGCUCAGGAGAAGUGAG-3' | (SEQ ID NO: 2710) |
| TTR-87 19 nt Target #3: | 5'-CCUAGCUCAGGAGAAGUGA-3' | (SEQ ID NO: 3094) |
| TTR-88 19 nt Target #1: | 5'-AGCUCAGGAGAAGUGAGUA-3' | (SEQ ID NO: 2327) |
| TTR-88 19 nt Target #2: | 5'-UAGCUCAGGAGAAGUGAGU-3' | (SEQ ID NO: 2711) |
| TTR-88 19 nt Target #3: | 5'-CUAGCUCAGGAGAAGUGAG-3' | (SEQ ID NO: 3095) |
| TTR-89 19 nt Target #1: | 5'-GCUCAGGAGAAGUGAGUAU-3' | (SEQ ID NO: 2328) |
| TTR-89 19 nt Target #2: | 5'-AGCUCAGGAGAAGUGAGUA-3' | (SEQ ID NO: 2712) |
| TTR-89 19 nt Target #3: | 5'-UAGCUCAGGAGAAGUGAGU-3' | (SEQ ID NO: 3096) |
| TTR-90 19 nt Target #1: | 5'-CUCAGGAGAAGUGAGUAUA-3' | (SEQ ID NO: 2329) |
| TTR-90 19 nt Target #2: | 5'-GCUCAGGAGAAGUGAGUAU-3' | (SEQ ID NO: 2713) |
| TTR-90 19 nt Target #3: | 5'-AGCUCAGGAGAAGUGAGUA-3' | (SEQ ID NO: 3097) |
| TTR-92 19 nt Target #1: | 5'-CAGGAGAAGUGAGUAUAAA-3' | (SEQ ID NO: 2330) |
| TTR-92 19 nt Target #2: | 5'-UCAGGAGAAGUGAGUAUAA-3' | (SEQ ID NO: 2714) |
| TTR-92 19 nt Target #3: | 5'-CUCAGGAGAAGUGAGUAUA-3' | (SEQ ID NO: 3098) |
| TTR-126 19 nt Target #1: | 5'-GCAGCCAUCACAGAAGUCC-3' | (SEQ ID NO: 2331) |
| TTR-126 19 nt Target #2: | 5'-AGCAGCCAUCACAGAAGUC-3' | (SEQ ID NO: 2715) |
| TTR-126 19 nt Target #3: | 5'-GAGCAGCCAUCACAGAAGU-3' | (SEQ ID NO: 3099) |
| TTR-127 19 nt Target #1: | 5'-CAGCCAUCACAGAAGUCCA-3' | (SEQ ID NO: 2332) |
| TTR-127 19 nt Target #2: | 5'-GCAGCCAUCACAGAAGUCC-3' | (SEQ ID NO: 2716) |
| TTR-127 19 nt Target #3: | 5'-AGCAGCCAUCACAGAAGUC-3' | (SEQ ID NO: 3100) |
| TTR-128 19 nt Target #1: | 5'-AGCCAUCACAGAAGUCCAC-3' | (SEQ ID NO: 2333) |
| TTR-128 19 nt Target #2: | 5'-CAGCCAUCACAGAAGUCCA-3' | (SEQ ID NO: 2717) |

TABLE 6-continued

DsiRNA Component 19 Nucleotide Target Sequences in Transthyretin mRNA

| | |
|---|---|
| TTR-128 19 nt Target #3: 5'-GCAGCCAUCACAGAAGUCC-3' | (SEQ ID NO: 3101) |
| TTR-129 19 nt Target #1: 5'-GCCAUCACAGAAGUCCACU-3' | (SEQ ID NO: 2334) |
| TTR-129 19 nt Target #2: 5'-AGCCAUCACAGAAGUCCAC-3' | (SEQ ID NO: 2718) |
| TTR-129 19 nt Target #3: 5'-CAGCCAUCACAGAAGUCCA-3' | (SEQ ID NO: 3102) |
| TTR-130 19 nt Target #1: 5'-CCAUCACAGAAGUCCACUC-3' | (SEQ ID NO: 2335) |
| TTR-130 19 nt Target #2: 5'-GCCAUCACAGAAGUCCACU-3' | (SEQ ID NO: 2719) |
| TTR-130 19 nt Target #3: 5'-AGCCAUCACAGAAGUCCAC-3' | (SEQ ID NO: 3103) |
| TTR-131 19 nt Target #1: 5'-CAUCACAGAAGUCCACUCA-3' | (SEQ ID NO: 2336) |
| TTR-131 19 nt Target #2: 5'-CCAUCACAGAAGUCCACUC-3' | (SEQ ID NO: 2720) |
| TTR-131 19 nt Target #3: 5'-GCCAUCACAGAAGUCCACU-3' | (SEQ ID NO: 3104) |
| TTR-132 19 nt Target #1: 5'-AUCACAGAAGUCCACUCAU-3' | (SEQ ID NO: 2337) |
| TTR-132 19 nt Target #2: 5'-CAUCACAGAAGUCCACUCA-3' | (SEQ ID NO: 2721) |
| TTR-132 19 nt Target #3: 5'-CCAUCACAGAAGUCCACUC-3' | (SEQ ID NO: 3105) |
| TTR-134 19 nt Target #1: 5'-CACAGAAGUCCACUCAUUC-3' | (SEQ ID NO: 2338) |
| TTR-134 19 nt Target #2: 5'-UCACAGAAGUCCACUCAUU-3' | (SEQ ID NO: 2722) |
| TTR-134 19 nt Target #3: 5'-AUCACAGAAGUCCACUCAU-3' | (SEQ ID NO: 3106) |
| TTR-135 19 nt Target #1: 5'-ACAGAAGUCCACUCAUUCU-3' | (SEQ ID NO: 2339) |
| TTR-135 19 nt Target #2: 5'-CACAGAAGUCCACUCAUUC-3' | (SEQ ID NO: 2723) |
| TTR-135 19 nt Target #3: 5'-UCACAGAAGUCCACUCAUU-3' | (SEQ ID NO: 3107) |
| TTR-150 19 nt Target #1: 5'-UUCUUGGCAGGAUGGCUUC-3' | (SEQ ID NO: 2340) |
| TTR-150 19 nt Target #2: 5'-AUUCUUGGCAGGAUGGCUU-3' | (SEQ ID NO: 2724) |
| TTR-150 19 nt Target #3: 5'-CAUUCUUGGCAGGAUGGCU-3' | (SEQ ID NO: 3108) |
| TTR-151 19 nt Target #1: 5'-UCUUGGCAGGAUGGCUUCU-3' | (SEQ ID NO: 2341) |
| TTR-151 19 nt Target #2: 5'-UUCUUGGCAGGAUGGCUUC-3' | (SEQ ID NO: 2725) |
| TTR-151 19 nt Target #3: 5'-AUUCUUGGCAGGAUGGCUU-3' | (SEQ ID NO: 3109) |
| TTR-152 19 nt Target #1: 5'-CUUGGCAGGAUGGCUUCUC-3' | (SEQ ID NO: 2342) |
| TTR-152 19 nt Target #2: 5'-UCUUGGCAGGAUGGCUUCU-3' | (SEQ ID NO: 2726) |
| TTR-152 19 nt Target #3: 5'-UUCUUGGCAGGAUGGCUUC-3' | (SEQ ID NO: 3110) |
| TTR-153 19 nt Target #1: 5'-UUGGCAGGAUGGCUUCUCA-3' | (SEQ ID NO: 2343) |
| TTR-153 19 nt Target #2: 5'-CUUGGCAGGAUGGCUUCUC-3' | (SEQ ID NO: 2727) |
| TTR-153 19 nt Target #3: 5'-UCUUGGCAGGAUGGCUUCU-3' | (SEQ ID NO: 3111) |
| TTR-154 19 nt Target #1: 5'-UGGCAGGAUGGCUUCUCAU-3' | (SEQ ID NO: 2344) |
| TTR-154 19 nt Target #2: 5'-UUGGCAGGAUGGCUUCUCA-3' | (SEQ ID NO: 2728) |
| TTR-154 19 nt Target #3: 5'-CUUGGCAGGAUGGCUUCUC-3' | (SEQ ID NO: 3112) |
| TTR-155 19 nt Target #1: 5'-GGCAGGAUGGCUUCUCAUC-3' | (SEQ ID NO: 2345) |
| TTR-155 19 nt Target #2: 5'-UGGCAGGAUGGCUUCUCAU-3' | (SEQ ID NO: 2729) |
| TTR-155 19 nt Target #3: 5'-UUGGCAGGAUGGCUUCUCA-3' | (SEQ ID NO: 3113) |
| TTR-156 19 nt Target #1: 5'-GCAGGAUGGCUUCUCAUCG-3' | (SEQ ID NO: 2346) |
| TTR-156 19 nt Target #2: 5'-GGCAGGAUGGCUUCUCAUC-3' | (SEQ ID NO: 2730) |

TABLE 6-continued

DsiRNA Component 19 Nucleotide Target Sequences in Transthyretin mRNA

| | |
|---|---|
| TTR-156 19 nt Target #3: 5'-UGGCAGGAUGGCUUCUCAU-3' | (SEQ ID NO: 3114) |
| TTR-157 19 nt Target #1: 5'-CAGGAUGGCUUCUCAUCGU-3' | (SEQ ID NO: 2347) |
| TTR-157 19 nt Target #2: 5'-GCAGGAUGGCUUCUCAUCG-3' | (SEQ ID NO: 2731) |
| TTR-157 19 nt Target #3: 5'-GGCAGGAUGGCUUCUCAUC-3' | (SEQ ID NO: 3115) |
| TTR-158 19 nt Target #1: 5'-AGGAUGGCUUCUCAUCGUC-3' | (SEQ ID NO: 2348) |
| TTR-158 19 nt Target #2: 5'-CAGGAUGGCUUCUCAUCGU-3' | (SEQ ID NO: 2732) |
| TTR-158 19 nt Target #3: 5'-GCAGGAUGGCUUCUCAUCG-3' | (SEQ ID NO: 3116) |
| TTR-159 19 nt Target #1: 5'-GGAUGGCUUCUCAUCGUCU-3' | (SEQ ID NO: 2349) |
| TTR-159 19 nt Target #2: 5'-AGGAUGGCUUCUCAUCGUC-3' | (SEQ ID NO: 2733) |
| TTR-159 19 nt Target #3: 5'-CAGGAUGGCUUCUCAUCGU-3' | (SEQ ID NO: 3117) |
| TTR-160 19 nt Target #1: 5'-GAUGGCUUCUCAUCGUCUG-3' | (SEQ ID NO: 2350) |
| TTR-160 19 nt Target #2: 5'-GGAUGGCUUCUCAUCGUCU-3' | (SEQ ID NO: 2734) |
| TTR-160 19 nt Target #3: 5'-AGGAUGGCUUCUCAUCGUC-3' | (SEQ ID NO: 3118) |
| TTR-161 19 nt Target #1: 5'-AUGGCUUCUCAUCGUCUGC-3' | (SEQ ID NO: 2351) |
| TTR-161 19 nt Target #2: 5'-GAUGGCUUCUCAUCGUCUG-3' | (SEQ ID NO: 2735) |
| TTR-161 19 nt Target #3: 5'-GGAUGGCUUCUCAUCGUCU-3' | (SEQ ID NO: 3119) |
| TTR-162 19 nt Target #1: 5'-UGGCUUCUCAUCGUCUGCU-3' | (SEQ ID NO: 2352) |
| TTR-162 19 nt Target #2: 5'-AUGGCUUCUCAUCGUCUGC-3' | (SEQ ID NO: 2736) |
| TTR-162 19 nt Target #3: 5'-GAUGGCUUCUCAUCGUCUG-3' | (SEQ ID NO: 3120) |
| TTR-163 19 nt Target #1: 5'-GGCUUCUCAUCGUCUGCUC-3' | (SEQ ID NO: 2353) |
| TTR-163 19 nt Target #2: 5'-UGGCUUCUCAUCGUCUGCU-3' | (SEQ ID NO: 2737) |
| TTR-163 19 nt Target #3: 5'-AUGGCUUCUCAUCGUCUGC-3' | (SEQ ID NO: 3121) |
| TTR-164 19 nt Target #1: 5'-GCUUCUCAUCGUCUGCUCC-3' | (SEQ ID NO: 2354) |
| TTR-164 19 nt Target #2: 5'-GGCUUCUCAUCGUCUGCUC-3' | (SEQ ID NO: 2738) |
| TTR-164 19 nt Target #3: 5'-UGGCUUCUCAUCGUCUGCU-3' | (SEQ ID NO: 3122) |
| TTR-165 19 nt Target #1: 5'-CUUCUCAUCGUCUGCUCCU-3' | (SEQ ID NO: 2355) |
| TTR-165 19 nt Target #2: 5'-GCUUCUCAUCGUCUGCUCC-3' | (SEQ ID NO: 2739) |
| TTR-165 19 nt Target #3: 5'-GGCUUCUCAUCGUCUGCUC-3' | (SEQ ID NO: 3123) |
| TTR-186 19 nt Target #1: 5'-UCUGCCUUGCUGGACUGGU-3' | (SEQ ID NO: 2356) |
| TTR-186 19 nt Target #2: 5'-CUCUGCCUUGCUGGACUGG-3' | (SEQ ID NO: 2740) |
| TTR-186 19 nt Target #3: 5'-CCUCUGCCUUGCUGGACUG-3' | (SEQ ID NO: 3124) |
| TTR-187 19 nt Target #1: 5'-CUGCCUUGCUGGACUGGUA-3' | (SEQ ID NO: 2357) |
| TTR-187 19 nt Target #2: 5'-UCUGCCUUGCUGGACUGGU-3' | (SEQ ID NO: 2741) |
| TTR-187 19 nt Target #3: 5'-CUCUGCCUUGCUGGACUGG-3' | (SEQ ID NO: 3125) |
| TTR-234 19 nt Target #1: 5'-CCGGUGAAUCCAAGUGUCC-3' | (SEQ ID NO: 2358) |
| TTR-234 19 nt Target #2: 5'-ACCGGUGAAUCCAAGUGUC-3' | (SEQ ID NO: 2742) |
| TTR-234 19 nt Target #3: 5'-CACCGGUGAAUCCAAGUGU-3' | (SEQ ID NO: 3126) |
| TTR-238 19 nt Target #1: 5'-UGAAUCCAAGUGUCCUCUG-3' | (SEQ ID NO: 2359) |

TABLE 6-continued

DsiRNA Component 19 Nucleotide Target Sequences in Transthyretin mRNA

| | |
|---|---|
| TTR-238 19 nt Target #2: 5'-GUGAAUCCAAGUGUCCUCU-3' | (SEQ ID NO: 2743) |
| TTR-238 19 nt Target #3: 5'-GGUGAAUCCAAGUGUCCUC-3' | (SEQ ID NO: 3127) |
| TTR-239 19 nt Target #1: 5'-GAAUCCAAGUGUCCUCUGA-3' | (SEQ ID NO: 2360) |
| TTR-239 19 nt Target #2: 5'-UGAAUCCAAGUGUCCUCUG-3' | (SEQ ID NO: 2744) |
| TTR-239 19 nt Target #3: 5'-GUGAAUCCAAGUGUCCUCU-3' | (SEQ ID NO: 3128) |
| TTR-240 19 nt Target #1: 5'-AAUCCAAGUGUCCUCUGAU-3' | (SEQ ID NO: 2361) |
| TTR-240 19 nt Target #2: 5'-GAAUCCAAGUGUCCUCUGA-3' | (SEQ ID NO: 2745) |
| TTR-240 19 nt Target #3: 5'-UGAAUCCAAGUGUCCUCUG-3' | (SEQ ID NO: 3129) |
| TTR-241 19 nt Target #1: 5'-AUCCAAGUGUCCUCUGAUG-3' | (SEQ ID NO: 2362) |
| TTR-241 19 nt Target #2: 5'-AAUCCAAGUGUCCUCUGAU-3' | (SEQ ID NO: 2746) |
| TTR-241 19 nt Target #3: 5'-GAAUCCAAGUGUCCUCUGA-3' | (SEQ ID NO: 3130) |
| TTR-242 19 nt Target #1: 5'-UCCAAGUGUCCUCUGAUGG-3' | (SEQ ID NO: 2363) |
| TTR-242 19 nt Target #2: 5'-AUCCAAGUGUCCUCUGAUG-3' | (SEQ ID NO: 2747) |
| TTR-242 19 nt Target #3: 5'-AAUCCAAGUGUCCUCUGAU-3' | (SEQ ID NO: 3131) |
| TTR-243 19 nt Target #1: 5'-CCAAGUGUCCUCUGAUGGU-3' | (SEQ ID NO: 2364) |
| TTR-243 19 nt Target #2: 5'-UCCAAGUGUCCUCUGAUGG-3' | (SEQ ID NO: 2748) |
| TTR-243 19 nt Target #3: 5'-AUCCAAGUGUCCUCUGAUG-3' | (SEQ ID NO: 3132) |
| TTR-244 19 nt Target #1: 5'-CAAGUGUCCUCUGAUGGUC-3' | (SEQ ID NO: 2365) |
| TTR-244 19 nt Target #2: 5'-CCAAGUGUCCUCUGAUGGU-3' | (SEQ ID NO: 2749) |
| TTR-244 19 nt Target #3: 5'-UCCAAGUGUCCUCUGAUGG-3' | (SEQ ID NO: 3133) |
| TTR-245 19 nt Target #1: 5'-AAGUGUCCUCUGAUGGUCA-3' | (SEQ ID NO: 2366) |
| TTR-245 19 nt Target #2: 5'-CAAGUGUCCUCUGAUGGUC-3' | (SEQ ID NO: 2750) |
| TTR-245 19 nt Target #3: 5'-CCAAGUGUCCUCUGAUGGU-3' | (SEQ ID NO: 3134) |
| TTR-246 19 nt Target #1: 5'-AGUGUCCUCUGAUGGUCAA-3' | (SEQ ID NO: 2367) |
| TTR-246 19 nt Target #2: 5'-AAGUGUCCUCUGAUGGUCA-3' | (SEQ ID NO: 2751) |
| TTR-246 19 nt Target #3: 5'-CAAGUGUCCUCUGAUGGUC-3' | (SEQ ID NO: 3135) |
| TTR-247 19 nt Target #1: 5'-GUGUCCUCUGAUGGUCAAA-3' | (SEQ ID NO: 2368) |
| TTR-247 19 nt Target #2: 5'-AGUGUCCUCUGAUGGUCAA-3' | (SEQ ID NO: 2752) |
| TTR-247 19 nt Target #3: 5'-AAGUGUCCUCUGAUGGUCA-3' | (SEQ ID NO: 3136) |
| TTR-248 19 nt Target #1: 5'-UGUCCUCUGAUGGUCAAAG-3' | (SEQ ID NO: 2369) |
| TTR-248 19 nt Target #2: 5'-GUGUCCUCUGAUGGUCAAA-3' | (SEQ ID NO: 2753) |
| TTR-248 19 nt Target #3: 5'-AGUGUCCUCUGAUGGUCAA-3' | (SEQ ID NO: 3137) |
| TTR-249 19 nt Target #1: 5'-GUCCUCUGAUGGUCAAAGU-3' | (SEQ ID NO: 2370) |
| TTR-249 19 nt Target #2: 5'-UGUCCUCUGAUGGUCAAAG-3' | (SEQ ID NO: 2754) |
| TTR-249 19 nt Target #3: 5'-GUGUCCUCUGAUGGUCAAA-3' | (SEQ ID NO: 3138) |
| TTR-250 19 nt Target #1: 5'-UCCUCUGAUGGUCAAAGUU-3' | (SEQ ID NO: 2371) |
| TTR-250 19 nt Target #2: 5'-GUCCUCUGAUGGUCAAAGU-3' | (SEQ ID NO: 2755) |
| TTR-250 19 nt Target #3: 5'-UGUCCUCUGAUGGUCAAAG-3' | (SEQ ID NO: 3139) |
| TTR-251 19 nt Target #1: 5'-CCUCUGAUGGUCAAAGUUC-3' | (SEQ ID NO: 2372) |

TABLE 6-continued

DsiRNA Component 19 Nucleotide Target Sequences in Transthyretin mRNA

| | | |
|---|---|---|
| TTR-251 19 nt Target #2: | 5'-UCCUCUGAUGGUCAAAGUU-3' | (SEQ ID NO: 2756) |
| TTR-251 19 nt Target #3: | 5'-GUCCUCUGAUGGUCAAAGU-3' | (SEQ ID NO: 3140) |
| TTR-252 19 nt Target #1: | 5'-CUCUGAUGGUCAAAGUUCU-3' | (SEQ ID NO: 2373) |
| TTR-252 19 nt Target #2: | 5'-CCUCUGAUGGUCAAAGUUC-3' | (SEQ ID NO: 2757) |
| TTR-252 19 nt Target #3: | 5'-UCCUCUGAUGGUCAAAGUU-3' | (SEQ ID NO: 3141) |
| TTR-253 19 nt Target #1: | 5'-UCUGAUGGUCAAAGUUCUA-3' | (SEQ ID NO: 2374) |
| TTR-253 19 nt Target #2: | 5'-CUCUGAUGGUCAAAGUUCU-3' | (SEQ ID NO: 2758) |
| TTR-253 19 nt Target #3: | 5'-CCUCUGAUGGUCAAAGUUC-3' | (SEQ ID NO: 3142) |
| TTR-254 19 nt Target #1: | 5'-CUGAUGGUCAAAGUUCUAG-3' | (SEQ ID NO: 2375) |
| TTR-254 19 nt Target #2: | 5'-UCUGAUGGUCAAAGUUCUA-3' | (SEQ ID NO: 2759) |
| TTR-254 19 nt Target #3: | 5'-CUCUGAUGGUCAAAGUUCU-3' | (SEQ ID NO: 3143) |
| TTR-255 19 nt Target #1: | 5'-UGAUGGUCAAAGUUCUAGA-3' | (SEQ ID NO: 2376) |
| TTR-255 19 nt Target #2: | 5'-CUGAUGGUCAAAGUUCUAG-3' | (SEQ ID NO: 2760) |
| TTR-255 19 nt Target #3: | 5'-UCUGAUGGUCAAAGUUCUA-3' | (SEQ ID NO: 3144) |
| TTR-256 19 nt Target #1: | 5'-GAUGGUCAAAGUUCUAGAU-3' | (SEQ ID NO: 2377) |
| TTR-256 19 nt Target #2: | 5'-UGAUGGUCAAAGUUCUAGA-3' | (SEQ ID NO: 2761) |
| TTR-256 19 nt Target #3: | 5'-CUGAUGGUCAAAGUUCUAG-3' | (SEQ ID NO: 3145) |
| TTR-257 19 nt Target #1: | 5'-AUGGUCAAAGUUCUAGAUG-3' | (SEQ ID NO: 2378) |
| TTR-257 19 nt Target #2: | 5'-GAUGGUCAAAGUUCUAGAU-3' | (SEQ ID NO: 2762) |
| TTR-257 19 nt Target #3: | 5'-UGAUGGUCAAAGUUCUAGA-3' | (SEQ ID NO: 3146) |
| TTR-258 19 nt Target #1: | 5'-UGGUCAAAGUUCUAGAUGC-3' | (SEQ ID NO: 2379) |
| TTR-258 19 nt Target #2: | 5'-AUGGUCAAAGUUCUAGAUG-3' | (SEQ ID NO: 2763) |
| TTR-258 19 nt Target #3: | 5'-GAUGGUCAAAGUUCUAGAU-3' | (SEQ ID NO: 3147) |
| TTR-346 19 nt Target #1: | 5'-GCCAUUUGCCUCUGGGAAA-3' | (SEQ ID NO: 2380) |
| TTR-346 19 nt Target #2: | 5'-AGCCAUUUGCCUCUGGGAA-3' | (SEQ ID NO: 2764) |
| TTR-346 19 nt Target #3: | 5'-GAGCCAUUUGCCUCUGGGA-3' | (SEQ ID NO: 3148) |
| TTR-347 19 nt Target #1: | 5'-CCAUUUGCCUCUGGGAAAA-3' | (SEQ ID NO: 2381) |
| TTR-347 19 nt Target #2: | 5'-GCCAUUUGCCUCUGGGAAA-3' | (SEQ ID NO: 2765) |
| TTR-347 19 nt Target #3: | 5'-AGCCAUUUGCCUCUGGGAA-3' | (SEQ ID NO: 3149) |
| TTR-348 19 nt Target #1: | 5'-CAUUUGCCUCUGGGAAAAC-3' | (SEQ ID NO: 2382) |
| TTR-348 19 nt Target #2: | 5'-CCAUUUGCCUCUGGGAAAA-3' | (SEQ ID NO: 2766) |
| TTR-348 19 nt Target #3: | 5'-GCCAUUUGCCUCUGGGAAA-3' | (SEQ ID NO: 3150) |
| TTR-349 19 nt Target #1: | 5'-AUUUGCCUCUGGGAAAACC-3' | (SEQ ID NO: 2383) |
| TTR-349 19 nt Target #2: | 5'-CAUUUGCCUCUGGGAAAAC-3' | (SEQ ID NO: 2767) |
| TTR-349 19 nt Target #3: | 5'-CCAUUUGCCUCUGGGAAAA-3' | (SEQ ID NO: 3151) |
| TTR-350 19 nt Target #1: | 5'-UUUGCCUCUGGGAAAACCA-3' | (SEQ ID NO: 2384) |
| TTR-350 19 nt Target #2: | 5'-AUUUGCCUCUGGGAAAACC-3' | (SEQ ID NO: 2768) |
| TTR-350 19 nt Target #3: | 5'-CAUUUGCCUCUGGGAAAAC-3' | (SEQ ID NO: 3152) |

TABLE 6-continued

DsiRNA Component 19 Nucleotide Target Sequences in Transthyretin mRNA

| | |
|---|---|
| TTR-351 19 nt Target #1: 5'-UUGCCUCUGGGAAAACCAG-3' | (SEQ ID NO: 2385) |
| TTR-351 19 nt Target #2: 5'-UUUGCCUCUGGGAAAACCA-3' | (SEQ ID NO: 2769) |
| TTR-351 19 nt Target #3: 5'-AUUUGCCUCUGGGAAAACC-3' | (SEQ ID NO: 3153) |
| TTR-352 19 nt Target #1: 5'-UGCCUCUGGGAAAACCAGU-3' | (SEQ ID NO: 2386) |
| TTR-352 19 nt Target #2: 5'-UUGCCUCUGGGAAAACCAG-3' | (SEQ ID NO: 2770) |
| TTR-352 19 nt Target #3: 5'-UUUGCCUCUGGGAAAACCA-3' | (SEQ ID NO: 3154) |
| TTR-353 19 nt Target #1: 5'-GCCUCUGGGAAAACCAGUG-3' | (SEQ ID NO: 2387) |
| TTR-353 19 nt Target #2: 5'-UGCCUCUGGGAAAACCAGU-3' | (SEQ ID NO: 2771) |
| TTR-353 19 nt Target #3: 5'-UUGCCUCUGGGAAAACCAG-3' | (SEQ ID NO: 3155) |
| TTR-354 19 nt Target #1: 5'-CCUCUGGGAAAACCAGUGA-3' | (SEQ ID NO: 2388) |
| TTR-354 19 nt Target #2: 5'-GCCUCUGGGAAAACCAGUG-3' | (SEQ ID NO: 2772) |
| TTR-354 19 nt Target #3: 5'-UGCCUCUGGGAAAACCAGU-3' | (SEQ ID NO: 3156) |
| TTR-355 19 nt Target #1: 5'-CUCUGGGAAAACCAGUGAG-3' | (SEQ ID NO: 2389) |
| TTR-355 19 nt Target #2: 5'-CCUCUGGGAAAACCAGUGA-3' | (SEQ ID NO: 2773) |
| TTR-355 19 nt Target #3: 5'-GCCUCUGGGAAAACCAGUG-3' | (SEQ ID NO: 3157) |
| TTR-356 19 nt Target #1: 5'-UCUGGGAAAACCAGUGAGU-3' | (SEQ ID NO: 2390) |
| TTR-356 19 nt Target #2: 5'-CUCUGGGAAAACCAGUGAG-3' | (SEQ ID NO: 2774) |
| TTR-356 19 nt Target #3: 5'-CCUCUGGGAAAACCAGUGA-3' | (SEQ ID NO: 3158) |
| TTR-357 19 nt Target #1: 5'-CUGGGAAAACCAGUGAGUC-3' | (SEQ ID NO: 2391) |
| TTR-357 19 nt Target #2: 5'-UCUGGGAAAACCAGUGAGU-3' | (SEQ ID NO: 2775) |
| TTR-357 19 nt Target #3: 5'-CUCUGGGAAAACCAGUGAG-3' | (SEQ ID NO: 3159) |
| TTR-358 19 nt Target #1: 5'-UGGGAAAACCAGUGAGUCU-3' | (SEQ ID NO: 2392) |
| TTR-358 19 nt Target #2: 5'-CUGGGAAAACCAGUGAGUC-3' | (SEQ ID NO: 2776) |
| TTR-358 19 nt Target #3: 5'-UCUGGGAAAACCAGUGAGU-3' | (SEQ ID NO: 3160) |
| TTR-359 19 nt Target #1: 5'-GGGAAAACCAGUGAGUCUG-3' | (SEQ ID NO: 2393) |
| TTR-359 19 nt Target #2: 5'-UGGGAAAACCAGUGAGUCU-3' | (SEQ ID NO: 2777) |
| TTR-359 19 nt Target #3: 5'-CUGGGAAAACCAGUGAGUC-3' | (SEQ ID NO: 3161) |
| TTR-360 19 nt Target #1: 5'-GGAAAACCAGUGAGUCUGG-3' | (SEQ ID NO: 2394) |
| TTR-360 19 nt Target #2: 5'-GGGAAAACCAGUGAGUCUG-3' | (SEQ ID NO: 2778) |
| TTR-360 19 nt Target #3: 5'-UGGGAAAACCAGUGAGUCU-3' | (SEQ ID NO: 3162) |
| TTR-361 19 nt Target #1: 5'-GAAAACCAGUGAGUCUGGA-3' | (SEQ ID NO: 2395) |
| TTR-361 19 nt Target #2: 5'-GGAAAACCAGUGAGUCUGG-3' | (SEQ ID NO: 2779) |
| TTR-361 19 nt Target #3: 5'-GGGAAAACCAGUGAGUCUG-3' | (SEQ ID NO: 3163) |
| TTR-381 19 nt Target #1: 5'-AGCUGCAUGGGCUCACAAC-3' | (SEQ ID NO: 2396) |
| TTR-381 19 nt Target #2: 5'-GAGCUGCAUGGGCUCACAA-3' | (SEQ ID NO: 2780) |
| TTR-381 19 nt Target #3: 5'-AGAGCUGCAUGGGCUCACA-3' | (SEQ ID NO: 3164) |
| TTR-382 19 nt Target #1: 5'-GCUGCAUGGGCUCACAACU-3' | (SEQ ID NO: 2397) |
| TTR-382 19 nt Target #2: 5'-AGCUGCAUGGGCUCACAAC-3' | (SEQ ID NO: 2781) |
| TTR-382 19 nt Target #3: 5'-GAGCUGCAUGGGCUCACAA-3' | (SEQ ID NO: 3165) |

TABLE 6-continued

DsiRNA Component 19 Nucleotide Target Sequences in Transthyretin mRNA

TTR-383 19 nt Target #1: 5'-CUGCAUGGGCUCACAACUG-3' (SEQ ID NO: 2398)

TTR-383 19 nt Target #2: 5'-GCUGCAUGGGCUCACAACU-3' (SEQ ID NO: 2782)

TTR-383 19 nt Target #3: 5'-AGCUGCAUGGGCUCACAAC-3' (SEQ ID NO: 3166)

TTR-384 19 nt Target #1: 5'-UGCAUGGGCUCACAACUGA-3' (SEQ ID NO: 2399)

TTR-384 19 nt Target #2: 5'-CUGCAUGGGCUCACAACUG-3' (SEQ ID NO: 2783)

TTR-384 19 nt Target #3: 5'-GCUGCAUGGGCUCACAACU-3' (SEQ ID NO: 3167)

TTR-385 19 nt Target #1: 5'-GCAUGGGCUCACAACUGAG-3' (SEQ ID NO: 2400)

TTR-385 19 nt Target #2: 5'-UGCAUGGGCUCACAACUGA-3' (SEQ ID NO: 2784)

TTR-385 19 nt Target #3: 5'-CUGCAUGGGCUCACAACUG-3' (SEQ ID NO: 3168)

TTR-386 19 nt Target #1: 5'-CAUGGGCUCACAACUGAGG-3' (SEQ ID NO: 2401)

TTR-386 19 nt Target #2: 5'-GCAUGGGCUCACAACUGAG-3' (SEQ ID NO: 2785)

TTR-386 19 nt Target #3: 5'-UGCAUGGGCUCACAACUGA-3' (SEQ ID NO: 3169)

TTR-387 19 nt Target #1: 5'-AUGGGCUCACAACUGAGGA-3' (SEQ ID NO: 2402)

TTR-387 19 nt Target #2: 5'-CAUGGGCUCACAACUGAGG-3' (SEQ ID NO: 2786)

TTR-387 19 nt Target #3: 5'-GCAUGGGCUCACAACUGAG-3' (SEQ ID NO: 3170)

TTR-388 19 nt Target #1: 5'-UGGGCUCACAACUGAGGAG-3' (SEQ ID NO: 2403)

TTR-388 19 nt Target #2: 5'-AUGGGCUCACAACUGAGGA-3' (SEQ ID NO: 2787)

TTR-388 19 nt Target #3: 5'-CAUGGGCUCACAACUGAGG-3' (SEQ ID NO: 3171)

TTR-389 19 nt Target #1: 5'-GGGCUCACAACUGAGGAGG-3' (SEQ ID NO: 2404)

TTR-389 19 nt Target #2: 5'-UGGGCUCACAACUGAGGAG-3' (SEQ ID NO: 2788)

TTR-389 19 nt Target #3: 5'-AUGGGCUCACAACUGAGGA-3' (SEQ ID NO: 3172)

TTR-390 19 nt Target #1: 5'-GGCUCACAACUGAGGAGGA-3' (SEQ ID NO: 2405)

TTR-390 19 nt Target #2: 5'-GGGCUCACAACUGAGGAGG-3' (SEQ ID NO: 2789)

TTR-390 19 nt Target #3: 5'-UGGGCUCACAACUGAGGAG-3' (SEQ ID NO: 3173)

TTR-391 19 nt Target #1: 5'-GCUCACAACUGAGGAGGAA-3' (SEQ ID NO: 2406)

TTR-391 19 nt Target #2: 5'-GGCUCACAACUGAGGAGGA-3' (SEQ ID NO: 2790)

TTR-391 19 nt Target #3: 5'-GGGCUCACAACUGAGGAGG-3' (SEQ ID NO: 3174)

TTR-392 19 nt Target #1: 5'-CUCACAACUGAGGAGGAAU-3' (SEQ ID NO: 2407)

TTR-392 19 nt Target #2: 5'-GCUCACAACUGAGGAGGAA-3' (SEQ ID NO: 2791)

TTR-392 19 nt Target #3: 5'-GGCUCACAACUGAGGAGGA-3' (SEQ ID NO: 3175)

TTR-393 19 nt Target #1: 5'-UCACAACUGAGGAGGAAUU-3' (SEQ ID NO: 2408)

TTR-393 19 nt Target #2: 5'-CUCACAACUGAGGAGGAAU-3' (SEQ ID NO: 2792)

TTR-393 19 nt Target #3: 5'-GCUCACAACUGAGGAGGAA-3' (SEQ ID NO: 3176)

TTR-394 19 nt Target #1: 5'-CACAACUGAGGAGGAAUUU-3' (SEQ ID NO: 2409)

TTR-394 19 nt Target #2: 5'-UCACAACUGAGGAGGAAUU-3' (SEQ ID NO: 2793)

TTR-394 19 nt Target #3: 5'-CUCACAACUGAGGAGGAAU-3' (SEQ ID NO: 3177)

TTR-395 19 nt Target #1: 5'-ACAACUGAGGAGGAAUUUG-3' (SEQ ID NO: 2410)

TTR-395 19 nt Target #2: 5'-CACAACUGAGGAGGAAUUU-3' (SEQ ID NO: 2794)

TABLE 6-continued

DsiRNA Component 19 Nucleotide Target Sequences in Transthyretin mRNA

TTR-395 19 nt Target #3: 5'-UCACAACUGAGGAGGAAUU-3' (SEQ ID NO: 3178)

TTR-396 19 nt Target #1: 5'-CAACUGAGGAGGAAUUUGU-3' (SEQ ID NO: 2411)

TTR-396 19 nt Target #2: 5'-ACAACUGAGGAGGAAUUUG-3' (SEQ ID NO: 2795)

TTR-396 19 nt Target #3: 5'-CACAACUGAGGAGGAAUUU-3' (SEQ ID NO: 3179)

TTR-398 19 nt Target #1: 5'-ACUGAGGAGGAAUUUGUAG-3' (SEQ ID NO: 2412)

TTR-398 19 nt Target #2: 5'-AACUGAGGAGGAAUUUGUA-3' (SEQ ID NO: 2796)

TTR-398 19 nt Target #3: 5'-CAACUGAGGAGGAAUUUGU-3' (SEQ ID NO: 3180)

TTR-399 19 nt Target #1: 5'-CUGAGGAGGAAUUUGUAGA-3' (SEQ ID NO: 2413)

TTR-399 19 nt Target #2: 5'-ACUGAGGAGGAAUUUGUAG-3' (SEQ ID NO: 2797)

TTR-399 19 nt Target #3: 5'-AACUGAGGAGGAAUUUGUA-3' (SEQ ID NO: 3181)

TTR-400 19 nt Target #1: 5'-UGAGGAGGAAUUUGUAGAA-3' (SEQ ID NO: 2414)

TTR-400 19 nt Target #2: 5'-CUGAGGAGGAAUUUGUAGA-3' (SEQ ID NO: 2798)

TTR-400 19 nt Target #3: 5'-ACUGAGGAGGAAUUUGUAG-3' (SEQ ID NO: 3182)

TTR-401 19 nt Target #1: 5'-GAGGAGGAAUUUGUAGAAG-3' (SEQ ID NO: 2415)

TTR-401 19 nt Target #2: 5'-UGAGGAGGAAUUUGUAGAA-3' (SEQ ID NO: 2799)

TTR-401 19 nt Target #3: 5'-CUGAGGAGGAAUUUGUAGA-3' (SEQ ID NO: 3183)

TTR-402 19 nt Target #1: 5'-AGGAGGAAUUUGUAGAAGG-3' (SEQ ID NO: 2416)

TTR-402 19 nt Target #2: 5'-GAGGAGGAAUUUGUAGAAG-3' (SEQ ID NO: 2800)

TTR-402 19 nt Target #3: 5'-UGAGGAGGAAUUUGUAGAA-3' (SEQ ID NO: 3184)

TTR-403 19 nt Target #1: 5'-GGAGGAAUUUGUAGAAGGG-3' (SEQ ID NO: 2417)

TTR-403 19 nt Target #2: 5'-AGGAGGAAUUUGUAGAAGG-3' (SEQ ID NO: 2801)

TTR-403 19 nt Target #3: 5'-GAGGAGGAAUUUGUAGAAG-3' (SEQ ID NO: 3185)

TTR-404 19 nt Target #1: 5'-GAGGAAUUUGUAGAAGGGA-3' (SEQ ID NO: 2418)

TTR-404 19 nt Target #2: 5'-GGAGGAAUUUGUAGAAGGG-3' (SEQ ID NO: 2802)

TTR-404 19 nt Target #3: 5'-AGGAGGAAUUUGUAGAAGG-3' (SEQ ID NO: 3186)

TTR-405 19 nt Target #1: 5'-AGGAAUUUGUAGAAGGGAU-3' (SEQ ID NO: 2419)

TTR-405 19 nt Target #2: 5'-GAGGAAUUUGUAGAAGGGA-3' (SEQ ID NO: 2803)

TTR-405 19 nt Target #3: 5'-GGAGGAAUUUGUAGAAGGG-3' (SEQ ID NO: 3187)

TTR-406 19 nt Target #1: 5'-GGAAUUUGUAGAAGGGAUA-3' (SEQ ID NO: 2420)

TTR-406 19 nt Target #2: 5'-AGGAAUUUGUAGAAGGGAU-3' (SEQ ID NO: 2804)

TTR-406 19 nt Target #3: 5'-GAGGAAUUUGUAGAAGGGA-3' (SEQ ID NO: 3188)

TTR-407 19 nt Target #1: 5'-GAAUUUGUAGAAGGGAUAU-3' (SEQ ID NO: 2421)

TTR-407 19 nt Target #2: 5'-GGAAUUUGUAGAAGGGAUA-3' (SEQ ID NO: 2805)

TTR-407 19 nt Target #3: 5'-AGGAAUUUGUAGAAGGGAU-3' (SEQ ID NO: 3189)

TTR-408 19 nt Target #1: 5'-AAUUUGUAGAAGGGAUAUA-3' (SEQ ID NO: 2422)

TTR-408 19 nt Target #2: 5'-GAAUUUGUAGAAGGGAUAU-3' (SEQ ID NO: 2806)

TTR-408 19 nt Target #3: 5'-GGAAUUUGUAGAAGGGAUA-3' (SEQ ID NO: 3190)

TTR-409 19 nt Target #1: 5'-AUUUGUAGAAGGGAUAUAC-3' (SEQ ID NO: 2423)

TTR-409 19 nt Target #2: 5'-AAUUUGUAGAAGGGAUAUA-3' (SEQ ID NO: 2807)

TABLE 6-continued

DsiRNA Component 19 Nucleotide Target Sequences in Transthyretin mRNA

TTR-409 19 nt Target #3: 5'-GAAUUUGUAGAAGGGAUAU-3' (SEQ ID NO: 3191)

TTR-410 19 nt Target #1: 5'-UUUGUAGAAGGGAUAUACA-3' (SEQ ID NO: 2424)

TTR-410 19 nt Target #2: 5'-AUUUGUAGAAGGGAUAUAC-3' (SEQ ID NO: 2808)

TTR-410 19 nt Target #3: 5'-AAUUUGUAGAAGGGAUAUA-3' (SEQ ID NO: 3192)

TTR-411 19 nt Target #1: 5'-UUGUAGAAGGGAUAUACAA-3' (SEQ ID NO: 2425)

TTR-411 19 nt Target #2: 5'-UUUGUAGAAGGGAUAUACA-3' (SEQ ID NO: 2809)

TTR-411 19 nt Target #3: 5'-AUUUGUAGAAGGGAUAUAC-3' (SEQ ID NO: 3193)

TTR-412 19 nt Target #1: 5'-UGUAGAAGGGAUAUACAAA-3' (SEQ ID NO: 2426)

TTR-412 19 nt Target #2: 5'-UUGUAGAAGGGAUAUACAA-3' (SEQ ID NO: 2810)

TTR-412 19 nt Target #3: 5'-UUUGUAGAAGGGAUAUACA-3' (SEQ ID NO: 3194)

TTR-413 19 nt Target #1: 5'-GUAGAAGGGAUAUACAAAG-3' (SEQ ID NO: 2427)

TTR-413 19 nt Target #2: 5'-UGUAGAAGGGAUAUACAAA-3' (SEQ ID NO: 2811)

TTR-413 19 nt Target #3: 5'-UUGUAGAAGGGAUAUACAA-3' (SEQ ID NO: 3195)

TTR-414 19 nt Target #1: 5'-UAGAAGGGAUAUACAAAGU-3' (SEQ ID NO: 2428)

TTR-414 19 nt Target #2: 5'-GUAGAAGGGAUAUACAAAG-3' (SEQ ID NO: 2812)

TTR-414 19 nt Target #3: 5'-UGUAGAAGGGAUAUACAAA-3' (SEQ ID NO: 3196)

TTR-415 19 nt Target #1: 5'-AGAAGGGAUAUACAAAGUG-3' (SEQ ID NO: 2429)

TTR-415 19 nt Target #2: 5'-UAGAAGGGAUAUACAAAGU-3' (SEQ ID NO: 2813)

TTR-415 19 nt Target #3: 5'-GUAGAAGGGAUAUACAAAG-3' (SEQ ID NO: 3197)

TTR-416 19 nt Target #1: 5'-GAAGGGAUAUACAAAGUGG-3' (SEQ ID NO: 2430)

TTR-416 19 nt Target #2: 5'-AGAAGGGAUAUACAAAGUG-3' (SEQ ID NO: 2814)

TTR-416 19 nt Target #3: 5'-UAGAAGGGAUAUACAAAGU-3' (SEQ ID NO: 3198)

TTR-417 19 nt Target #1: 5'-AAGGGAUAUACAAAGUGGA-3' (SEQ ID NO: 2431)

TTR-417 19 nt Target #2: 5'-GAAGGGAUAUACAAAGUGG-3' (SEQ ID NO: 2815)

TTR-417 19 nt Target #3: 5'-AGAAGGGAUAUACAAAGUG-3' (SEQ ID NO: 3199)

TTR-418 19 nt Target #1: 5'-AGGGAUAUACAAAGUGGAA-3' (SEQ ID NO: 2432)

TTR-418 19 nt Target #2: 5'-AAGGGAUAUACAAAGUGGA-3' (SEQ ID NO: 2816)

TTR-418 19 nt Target #3: 5'-GAAGGGAUAUACAAAGUGG-3' (SEQ ID NO: 3200)

TTR-419 19 nt Target #1: 5'-GGGAUAUACAAAGUGGAAA-3' (SEQ ID NO: 2433)

TTR-419 19 nt Target #2: 5'-AGGGAUAUACAAAGUGGAA-3' (SEQ ID NO: 2817)

TTR-419 19 nt Target #3: 5'-AAGGGAUAUACAAAGUGGA-3' (SEQ ID NO: 3201)

TTR-420 19 nt Target #1: 5'-GGAUAUACAAAGUGGAAAU-3' (SEQ ID NO: 2434)

TTR-420 19 nt Target #2: 5'-GGGAUAUACAAAGUGGAAA-3' (SEQ ID NO: 2818)

TTR-420 19 nt Target #3: 5'-AGGGAUAUACAAAGUGGAA-3' (SEQ ID NO: 3202)

TTR-421 19 nt Target #1: 5'-GAUAUACAAAGUGGAAAUA-3' (SEQ ID NO: 2435)

TTR-421 19 nt Target #2: 5'-GGAUAUACAAAGUGGAAAU-3' (SEQ ID NO: 2819)

TTR-421 19 nt Target #3: 5'-GGGAUAUACAAAGUGGAAA-3' (SEQ ID NO: 3203)

TTR-422 19 nt Target #1: 5'-AUAUACAAAGUGGAAAUAG-3' (SEQ ID NO: 2436)

TABLE 6-continued

DsiRNA Component 19 Nucleotide Target Sequences in Transthyretin mRNA

| | |
|---|---|
| TTR-422 19 nt Target #2: 5'-GAUAUACAAAGUGGAAAUA-3' | (SEQ ID NO: 2820) |
| TTR-422 19 nt Target #3: 5'-GGAUAUACAAAGUGGAAAU-3' | (SEQ ID NO: 3204) |
| TTR-423 19 nt Target #1: 5'-UAUACAAAGUGGAAAUAGA-3' | (SEQ ID NO: 2437) |
| TTR-423 19 nt Target #2: 5'-AUAUACAAAGUGGAAAUAG-3' | (SEQ ID NO: 2821) |
| TTR-423 19 nt Target #3: 5'-GAUAUACAAAGUGGAAAUA-3' | (SEQ ID NO: 3205) |
| TTR-424 19 nt Target #1: 5'-AUACAAAGUGGAAAUAGAC-3' | (SEQ ID NO: 2438) |
| TTR-424 19 nt Target #2: 5'-UAUACAAAGUGGAAAUAGA-3' | (SEQ ID NO: 2822) |
| TTR-424 19 nt Target #3: 5'-AUAUACAAAGUGGAAAUAG-3' | (SEQ ID NO: 3206) |
| TTR-425 19 nt Target #1: 5'-UACAAAGUGGAAAUAGACA-3' | (SEQ ID NO: 2439) |
| TTR-425 19 nt Target #2: 5'-AUACAAAGUGGAAAUAGAC-3' | (SEQ ID NO: 2823) |
| TTR-425 19 nt Target #3: 5'-UAUACAAAGUGGAAAUAGA-3' | (SEQ ID NO: 3207) |
| TTR-426 19 nt Target #1: 5'-ACAAAGUGGAAAUAGACAC-3' | (SEQ ID NO: 2440) |
| TTR-426 19 nt Target #2: 5'-UACAAAGUGGAAAUAGACA-3' | (SEQ ID NO: 2824) |
| TTR-426 19 nt Target #3: 5'-AUACAAAGUGGAAAUAGAC-3' | (SEQ ID NO: 3208) |
| TTR-427 19 nt Target #1: 5'-CAAAGUGGAAAUAGACACC-3' | (SEQ ID NO: 2441) |
| TTR-427 19 nt Target #2: 5'-ACAAAGUGGAAAUAGACAC-3' | (SEQ ID NO: 2825) |
| TTR-427 19 nt Target #3: 5'-UACAAAGUGGAAAUAGACA-3' | (SEQ ID NO: 3209) |
| TTR-428 19 nt Target #1: 5'-AAAGUGGAAAUAGACACCA-3' | (SEQ ID NO: 2442) |
| TTR-428 19 nt Target #2: 5'-CAAAGUGGAAAUAGACACC-3' | (SEQ ID NO: 2826) |
| TTR-428 19 nt Target #3: 5'-ACAAAGUGGAAAUAGACAC-3' | (SEQ ID NO: 3210) |
| TTR-429 19 nt Target #1: 5'-AAGUGGAAAUAGACACCAA-3' | (SEQ ID NO: 2443) |
| TTR-429 19 nt Target #2: 5'-AAAGUGGAAAUAGACACCA-3' | (SEQ ID NO: 2827) |
| TTR-429 19 nt Target #3: 5'-CAAAGUGGAAAUAGACACC-3' | (SEQ ID NO: 3211) |
| TTR-430 19 nt Target #1: 5'-AGUGGAAAUAGACACCAAA-3' | (SEQ ID NO: 2444) |
| TTR-430 19 nt Target #2: 5'-AAGUGGAAAUAGACACCAA-3' | (SEQ ID NO: 2828) |
| TTR-430 19 nt Target #3: 5'-AAAGUGGAAAUAGACACCA-3' | (SEQ ID NO: 3212) |
| TTR-431 19 nt Target #1: 5'-GUGGAAAUAGACACCAAAU-3' | (SEQ ID NO: 2445) |
| TTR-431 19 nt Target #2: 5'-AGUGGAAAUAGACACCAAA-3' | (SEQ ID NO: 2829) |
| TTR-431 19 nt Target #3: 5'-AAGUGGAAAUAGACACCAA-3' | (SEQ ID NO: 3213) |
| TTR-432 19 nt Target #1: 5'-UGGAAAUAGACACCAAAUC-3' | (SEQ ID NO: 2446) |
| TTR-432 19 nt Target #2: 5'-GUGGAAAUAGACACCAAAU-3' | (SEQ ID NO: 2830) |
| TTR-432 19 nt Target #3: 5'-AGUGGAAAUAGACACCAAA-3' | (SEQ ID NO: 3214) |
| TTR-433 19 nt Target #1: 5'-GGAAAUAGACACCAAAUCU-3' | (SEQ ID NO: 2447) |
| TTR-433 19 nt Target #2: 5'-UGGAAAUAGACACCAAAUC-3' | (SEQ ID NO: 2831) |
| TTR-433 19 nt Target #3: 5'-GUGGAAAUAGACACCAAAU-3' | (SEQ ID NO: 3215) |
| TTR-434 19 nt Target #1: 5'-GAAAUAGACACCAAAUCUU-3' | (SEQ ID NO: 2448) |
| TTR-434 19 nt Target #2: 5'-GGAAAUAGACACCAAAUCU-3' | (SEQ ID NO: 2832) |
| TTR-434 19 nt Target #3: 5'-UGGAAAUAGACACCAAAUC-3' | (SEQ ID NO: 3216) |
| TTR-435 19 nt Target #1: 5'-AAAUAGACACCAAAUCUUA-3' | (SEQ ID NO: 2449) |

TABLE 6-continued

DsiRNA Component 19 Nucleotide Target Sequences in Transthyretin mRNA

TTR-435 19 nt Target #2: 5'-GAAAUAGACACCAAAUCUU-3' (SEQ ID NO: 2833)

TTR-435 19 nt Target #3: 5'-GGAAAUAGACACCAAAUCU-3' (SEQ ID NO: 3217)

TTR-436 19 nt Target #1: 5'-AAUAGACACCAAAUCUUAC-3' (SEQ ID NO: 2450)

TTR-436 19 nt Target #2: 5'-AAAUAGACACCAAAUCUUA-3' (SEQ ID NO: 2834)

TTR-436 19 nt Target #3: 5'-GAAAUAGACACCAAAUCUU-3' (SEQ ID NO: 3218)

TTR-437 19 nt Target #1: 5'-AUAGACACCAAAUCUUACU-3' (SEQ ID NO: 2451)

TTR-437 19 nt Target #2: 5'-AAUAGACACCAAAUCUUAC-3' (SEQ ID NO: 2835)

TTR-437 19 nt Target #3: 5'-AAAUAGACACCAAAUCUUA-3' (SEQ ID NO: 3219)

TTR-439 19 nt Target #1: 5'-AGACACCAAAUCUUACUGG-3' (SEQ ID NO: 2452)

TTR-439 19 nt Target #2: 5'-UAGACACCAAAUCUUACUG-3' (SEQ ID NO: 2836)

TTR-439 19 nt Target #3: 5'-AUAGACACCAAAUCUUACU-3' (SEQ ID NO: 3220)

TTR-440 19 nt Target #1: 5'-GACACCAAAUCUUACUGGA-3' (SEQ ID NO: 2453)

TTR-440 19 nt Target #2: 5'-AGACACCAAAUCUUACUGG-3' (SEQ ID NO: 2837)

TTR-440 19 nt Target #3: 5'-UAGACACCAAAUCUUACUG-3' (SEQ ID NO: 3221)

TTR-462 19 nt Target #1: 5'-CACUUGGCAUCUCCCCAUU-3' (SEQ ID NO: 2454)

TTR-462 19 nt Target #2: 5'-GCACUUGGCAUCUCCCCAU-3' (SEQ ID NO: 2838)

TTR-462 19 nt Target #3: 5'-GGCACUUGGCAUCUCCCCA-3' (SEQ ID NO: 3222)

TTR-463 19 nt Target #1: 5'-ACUUGGCAUCUCCCCAUUC-3' (SEQ ID NO: 2455)

TTR-463 19 nt Target #2: 5'-CACUUGGCAUCUCCCCAUU-3' (SEQ ID NO: 2839)

TTR-463 19 nt Target #3: 5'-GCACUUGGCAUCUCCCCAU-3' (SEQ ID NO: 3223)

TTR-464 19 nt Target #1: 5'-CUUGGCAUCUCCCCAUUCC-3' (SEQ ID NO: 2456)

TTR-464 19 nt Target #2: 5'-ACUUGGCAUCUCCCCAUUC-3' (SEQ ID NO: 2840)

TTR-464 19 nt Target #3: 5'-CACUUGGCAUCUCCCCAUU-3' (SEQ ID NO: 3224)

TTR-465 19 nt Target #1: 5'-UUGGCAUCUCCCCAUUCCA-3' (SEQ ID NO: 2457)

TTR-465 19 nt Target #2: 5'-CUUGGCAUCUCCCCAUUCC-3' (SEQ ID NO: 2841)

TTR-465 19 nt Target #3: 5'-ACUUGGCAUCUCCCCAUUC-3' (SEQ ID NO: 3225)

TTR-466 19 nt Target #1: 5'-UGGCAUCUCCCCAUUCCAU-3' (SEQ ID NO: 2458)

TTR-466 19 nt Target #2: 5'-UUGGCAUCUCCCCAUUCCA-3' (SEQ ID NO: 2842)

TTR-466 19 nt Target #3: 5'-CUUGGCAUCUCCCCAUUCC-3' (SEQ ID NO: 3226)

TTR-467 19 nt Target #1: 5'-GGCAUCUCCCCAUUCCAUG-3' (SEQ ID NO: 2459)

TTR-467 19 nt Target #2: 5'-UGGCAUCUCCCCAUUCCAU-3' (SEQ ID NO: 2843)

TTR-467 19 nt Target #3: 5'-UUGGCAUCUCCCCAUUCCA-3' (SEQ ID NO: 3227)

TTR-468 19 nt Target #1: 5'-GCAUCUCCCCAUUCCAUGA-3' (SEQ ID NO: 2460)

TTR-468 19 nt Target #2: 5'-GGCAUCUCCCCAUUCCAUG-3' (SEQ ID NO: 2844)

TTR-468 19 nt Target #3: 5'-UGGCAUCUCCCCAUUCCAU-3' (SEQ ID NO: 3228)

TTR-469 19 nt Target #1: 5'-CAUCUCCCCAUUCCAUGAG-3' (SEQ ID NO: 2461)

TTR-469 19 nt Target #2: 5'-GCAUCUCCCCAUUCCAUGA-3' (SEQ ID NO: 2845)

TTR-469 19 nt Target #3: 5'-GGCAUCUCCCCAUUCCAUG-3' (SEQ ID NO: 3229)

TABLE 6-continued

DsiRNA Component 19 Nucleotide Target Sequences in Transthyretin mRNA

| | | |
|---|---|---|
| TTR-470 19 nt Target #1: | 5'-AUCUCCCCAUUCCAUGAGC-3' | (SEQ ID NO: 2462) |
| TTR-470 19 nt Target #2: | 5'-CAUCUCCCCAUUCCAUGAG-3' | (SEQ ID NO: 2846) |
| TTR-470 19 nt Target #3: | 5'-GCAUCUCCCCAUUCCAUGA-3' | (SEQ ID NO: 3230) |
| TTR-471 19 nt Target #1: | 5'-UCUCCCCAUUCCAUGAGCA-3' | (SEQ ID NO: 2463) |
| TTR-471 19 nt Target #2: | 5'-AUCUCCCCAUUCCAUGAGC-3' | (SEQ ID NO: 2847) |
| TTR-471 19 nt Target #3: | 5'-CAUCUCCCCAUUCCAUGAG-3' | (SEQ ID NO: 3231) |
| TTR-472 19 nt Target #1: | 5'-CUCCCCAUUCCAUGAGCAU-3' | (SEQ ID NO: 2464) |
| TTR-472 19 nt Target #2: | 5'-UCUCCCCAUUCCAUGAGCA-3' | (SEQ ID NO: 2848) |
| TTR-472 19 nt Target #3: | 5'-AUCUCCCCAUUCCAUGAGC-3' | (SEQ ID NO: 3232) |
| TTR-473 19 nt Target #1: | 5'-UCCCCAUUCCAUGAGCAUG-3' | (SEQ ID NO: 2465) |
| TTR-473 19 nt Target #2: | 5'-CUCCCCAUUCCAUGAGCAU-3' | (SEQ ID NO: 2849) |
| TTR-473 19 nt Target #3: | 5'-UCUCCCCAUUCCAUGAGCA-3' | (SEQ ID NO: 3233) |
| TTR-474 19 nt Target #1: | 5'-CCCCAUUCCAUGAGCAUGC-3' | (SEQ ID NO: 2466) |
| TTR-474 19 nt Target #2: | 5'-UCCCCAUUCCAUGAGCAUG-3' | (SEQ ID NO: 2850) |
| TTR-474 19 nt Target #3: | 5'-CUCCCCAUUCCAUGAGCAU-3' | (SEQ ID NO: 3234) |
| TTR-482 19 nt Target #1: | 5'-CAUGAGCAUGCAGAGGUGG-3' | (SEQ ID NO: 2467) |
| TTR-482 19 nt Target #2: | 5'-CCAUGAGCAUGCAGAGGUG-3' | (SEQ ID NO: 2851) |
| TTR-482 19 nt Target #3: | 5'-UCCAUGAGCAUGCAGAGGU-3' | (SEQ ID NO: 3235) |
| TTR-483 19 nt Target #1: | 5'-AUGAGCAUGCAGAGGUGGU-3' | (SEQ ID NO: 2468) |
| TTR-483 19 nt Target #2: | 5'-CAUGAGCAUGCAGAGGUGG-3' | (SEQ ID NO: 2852) |
| TTR-483 19 nt Target #3: | 5'-CCAUGAGCAUGCAGAGGUG-3' | (SEQ ID NO: 3236) |
| TTR-484 19 nt Target #1: | 5'-UGAGCAUGCAGAGGUGGUA-3' | (SEQ ID NO: 2469) |
| TTR-484 19 nt Target #2: | 5'-AUGAGCAUGCAGAGGUGGU-3' | (SEQ ID NO: 2853) |
| TTR-484 19 nt Target #3: | 5'-CAUGAGCAUGCAGAGGUGG-3' | (SEQ ID NO: 3237) |
| TTR-485 19 nt Target #1: | 5'-GAGCAUGCAGAGGUGGUAU-3' | (SEQ ID NO: 2470) |
| TTR-485 19 nt Target #2: | 5'-UGAGCAUGCAGAGGUGGUA-3' | (SEQ ID NO: 2854) |
| TTR-485 19 nt Target #3: | 5'-AUGAGCAUGCAGAGGUGGU-3' | (SEQ ID NO: 3238) |
| TTR-489 19 nt Target #1: | 5'-AUGCAGAGGUGGUAUUCAC-3' | (SEQ ID NO: 2471) |
| TTR-489 19 nt Target #2: | 5'-CAUGCAGAGGUGGUAUUCA-3' | (SEQ ID NO: 2855) |
| TTR-489 19 nt Target #3: | 5'-GCAUGCAGAGGUGGUAUUC-3' | (SEQ ID NO: 3239) |
| TTR-493 19 nt Target #1: | 5'-AGAGGUGGUAUUCACAGCC-3' | (SEQ ID NO: 2472) |
| TTR-493 19 nt Target #2: | 5'-CAGAGGUGGUAUUCACAGC-3' | (SEQ ID NO: 2856) |
| TTR-493 19 nt Target #3: | 5'-GCAGAGGUGGUAUUCACAG-3' | (SEQ ID NO: 3240) |
| TTR-494 19 nt Target #1: | 5'-GAGGUGGUAUUCACAGCCA-3' | (SEQ ID NO: 2473) |
| TTR-494 19 nt Target #2: | 5'-AGAGGUGGUAUUCACAGCC-3' | (SEQ ID NO: 2857) |
| TTR-494 19 nt Target #3: | 5'-CAGAGGUGGUAUUCACAGC-3' | (SEQ ID NO: 3241) |
| TTR-581 19 nt Target #1: | 5'-GUCGUCACCAAUCCCAAGG-3' | (SEQ ID NO: 2474) |
| TTR-581 19 nt Target #2: | 5'-UGUCGUCACCAAUCCCAAG-3' | (SEQ ID NO: 2858) |
| TTR-581 19 nt Target #3: | 5'-CUGUCGUCACCAAUCCCAA-3' | (SEQ ID NO: 3242) |

TABLE 6-continued

DsiRNA Component 19 Nucleotide Target Sequences in Transthyretin mRNA

| | | |
|---|---|---|
| TTR-631 19 nt Target #1: | 5'-GGACGAGGGAUGGGAUUUC-3' | (SEQ ID NO: 2475) |
| TTR-631 19 nt Target #2: | 5'-AGGACGAGGGAUGGGAUUU-3' | (SEQ ID NO: 2859) |
| TTR-631 19 nt Target #3: | 5'-AAGGACGAGGGAUGGGAUU-3' | (SEQ ID NO: 3243) |
| TTR-632 19 nt Target #1: | 5'-GACGAGGGAUGGGAUUUCA-3' | (SEQ ID NO: 2476) |
| TTR-632 19 nt Target #2: | 5'-GGACGAGGGAUGGGAUUUC-3' | (SEQ ID NO: 2860) |
| TTR-632 19 nt Target #3: | 5'-AGGACGAGGGAUGGGAUUU-3' | (SEQ ID NO: 3244) |
| TTR-635 19 nt Target #1: | 5'-GAGGGAUGGGAUUUCAUGU-3' | (SEQ ID NO: 2477) |
| TTR-635 19 nt Target #2: | 5'-CGAGGGAUGGGAUUUCAUG-3' | (SEQ ID NO: 2861) |
| TTR-635 19 nt Target #3: | 5'-ACGAGGGAUGGGAUUUCAU-3' | (SEQ ID NO: 3245) |
| TTR-636 19 nt Target #1: | 5'-AGGGAUGGGAUUUCAUGUA-3' | (SEQ ID NO: 2478) |
| TTR-636 19 nt Target #2: | 5'-GAGGGAUGGGAUUUCAUGU-3' | (SEQ ID NO: 2862) |
| TTR-636 19 nt Target #3: | 5'-CGAGGGAUGGGAUUUCAUG-3' | (SEQ ID NO: 3246) |
| TTR-637 19 nt Target #1: | 5'-GGGAUGGGAUUUCAUGUAA-3' | (SEQ ID NO: 2479) |
| TTR-637 19 nt Target #2: | 5'-AGGGAUGGGAUUUCAUGUA-3' | (SEQ ID NO: 2863) |
| TTR-637 19 nt Target #3: | 5'-GAGGGAUGGGAUUUCAUGU-3' | (SEQ ID NO: 3247) |
| TTR-639 19 nt Target #1: | 5'-GAUGGGAUUUCAUGUAACC-3' | (SEQ ID NO: 2480) |
| TTR-639 19 nt Target #2: | 5'-GGAUGGGAUUUCAUGUAAC-3' | (SEQ ID NO: 2864) |
| TTR-639 19 nt Target #3: | 5'-GGGAUGGGAUUUCAUGUAA-3' | (SEQ ID NO: 3248) |
| TTR-640 19 nt Target #1: | 5'-AUGGGAUUUCAUGUAACCA-3' | (SEQ ID NO: 2481) |
| TTR-640 19 nt Target #2: | 5'-GAUGGGAUUUCAUGUAACC-3' | (SEQ ID NO: 2865) |
| TTR-640 19 nt Target #3: | 5'-GGAUGGGAUUUCAUGUAAC-3' | (SEQ ID NO: 3249) |
| TTR-641 19 nt Target #1: | 5'-UGGGAUUUCAUGUAACCAA-3' | (SEQ ID NO: 2482) |
| TTR-641 19 nt Target #2: | 5'-AUGGGAUUUCAUGUAACCA-3' | (SEQ ID NO: 2866) |
| TTR-641 19 nt Target #3: | 5'-GAUGGGAUUUCAUGUAACC-3' | (SEQ ID NO: 3250) |
| TTR-642 19 nt Target #1: | 5'-GGGAUUUCAUGUAACCAAG-3' | (SEQ ID NO: 2483) |
| TTR-642 19 nt Target #2: | 5'-UGGGAUUUCAUGUAACCAA-3' | (SEQ ID NO: 2867) |
| TTR-642 19 nt Target #3: | 5'-AUGGGAUUUCAUGUAACCA-3' | (SEQ ID NO: 3251) |
| TTR-643 19 nt Target #1: | 5'-GGAUUUCAUGUAACCAAGA-3' | (SEQ ID NO: 2484) |
| TTR-643 19 nt Target #2: | 5'-GGGAUUUCAUGUAACCAAG-3' | (SEQ ID NO: 2868) |
| TTR-643 19 nt Target #3: | 5'-UGGGAUUUCAUGUAACCAA-3' | (SEQ ID NO: 3252) |
| TTR-644 19 nt Target #1: | 5'-GAUUUCAUGUAACCAAGAG-3' | (SEQ ID NO: 2485) |
| TTR-644 19 nt Target #2: | 5'-GGAUUUCAUGUAACCAAGA-3' | (SEQ ID NO: 2869) |
| TTR-644 19 nt Target #3: | 5'-GGGAUUUCAUGUAACCAAG-3' | (SEQ ID NO: 3253) |
| TTR-645 19 nt Target #1: | 5'-AUUUCAUGUAACCAAGAGU-3' | (SEQ ID NO: 2486) |
| TTR-645 19 nt Target #2: | 5'-GAUUUCAUGUAACCAAGAG-3' | (SEQ ID NO: 2870) |
| TTR-645 19 nt Target #3: | 5'-GGAUUUCAUGUAACCAAGA-3' | (SEQ ID NO: 3254) |
| TTR-646 19 nt Target #1: | 5'-UUUCAUGUAACCAAGAGUA-3' | (SEQ ID NO: 2487) |
| TTR-646 19 nt Target #2: | 5'-AUUUCAUGUAACCAAGAGU-3' | (SEQ ID NO: 2871) |

TABLE 6-continued

DsiRNA Component 19 Nucleotide Target Sequences in Transthyretin mRNA

| | |
|---|---|
| TTR-646 19 nt Target #3: 5'-GAUUUCAUGUAACCAAGAG-3' | (SEQ ID NO: 3255) |
| TTR-647 19 nt Target #1: 5'-UUCAUGUAACCAAGAGUAU-3' | (SEQ ID NO: 2488) |
| TTR-647 19 nt Target #2: 5'-UUUCAUGUAACCAAGAGUA-3' | (SEQ ID NO: 2872) |
| TTR-647 19 nt Target #3: 5'-AUUUCAUGUAACCAAGAGU-3' | (SEQ ID NO: 3256) |
| TTR-648 19 nt Target #1: 5'-UCAUGUAACCAAGAGUAUU-3' | (SEQ ID NO: 2489) |
| TTR-648 19 nt Target #2: 5'-UUCAUGUAACCAAGAGUAU-3' | (SEQ ID NO: 2873) |
| TTR-648 19 nt Target #3: 5'-UUUCAUGUAACCAAGAGUA-3' | (SEQ ID NO: 3257) |
| TTR-649 19 nt Target #1: 5'-CAUGUAACCAAGAGUAUUC-3' | (SEQ ID NO: 2490) |
| TTR-649 19 nt Target #2: 5'-UCAUGUAACCAAGAGUAUU-3' | (SEQ ID NO: 2874) |
| TTR-649 19 nt Target #3: 5'-UUCAUGUAACCAAGAGUAU-3' | (SEQ ID NO: 3258) |
| TTR-650 19 nt Target #1: 5'-AUGUAACCAAGAGUAUUCC-3' | (SEQ ID NO: 2491) |
| TTR-650 19 nt Target #2: 5'-CAUGUAACCAAGAGUAUUC-3' | (SEQ ID NO: 2875) |
| TTR-650 19 nt Target #3: 5'-UCAUGUAACCAAGAGUAUU-3' | (SEQ ID NO: 3259) |
| TTR-651 19 nt Target #1: 5'-UGUAACCAAGAGUAUUCCA-3' | (SEQ ID NO: 2492) |
| TTR-651 19 nt Target #2: 5'-AUGUAACCAAGAGUAUUCC-3' | (SEQ ID NO: 2876) |
| TTR-651 19 nt Target #3: 5'-CAUGUAACCAAGAGUAUUC-3' | (SEQ ID NO: 3260) |
| TTR-652 19 nt Target #1: 5'-GUAACCAAGAGUAUUCCAU-3' | (SEQ ID NO: 2493) |
| TTR-652 19 nt Target #2: 5'-UGUAACCAAGAGUAUUCCA-3' | (SEQ ID NO: 2877) |
| TTR-652 19 nt Target #3: 5'-AUGUAACCAAGAGUAUUCC-3' | (SEQ ID NO: 3261) |
| TTR-653 19 nt Target #1: 5'-UAACCAAGAGUAUUCCAUU-3' | (SEQ ID NO: 2494) |
| TTR-653 19 nt Target #2: 5'-GUAACCAAGAGUAUUCCAU-3' | (SEQ ID NO: 2878) |
| TTR-653 19 nt Target #3: 5'-UGUAACCAAGAGUAUUCCA-3' | (SEQ ID NO: 3262) |
| TTR-654 19 nt Target #1: 5'-AACCAAGAGUAUUCCAUUU-3' | (SEQ ID NO: 2495) |
| TTR-654 19 nt Target #2: 5'-UAACCAAGAGUAUUCCAUU-3' | (SEQ ID NO: 2879) |
| TTR-654 19 nt Target #3: 5'-GUAACCAAGAGUAUUCCAU-3' | (SEQ ID NO: 3263) |
| TTR-655 19 nt Target #1: 5'-ACCAAGAGUAUUCCAUUUU-3' | (SEQ ID NO: 2496) |
| TTR-655 19 nt Target #2: 5'-AACCAAGAGUAUUCCAUUU-3' | (SEQ ID NO: 2880) |
| TTR-655 19 nt Target #3: 5'-UAACCAAGAGUAUUCCAUU-3' | (SEQ ID NO: 3264) |
| TTR-656 19 nt Target #1: 5'-CCAAGAGUAUUCCAUUUUU-3' | (SEQ ID NO: 2497) |
| TTR-656 19 nt Target #2: 5'-ACCAAGAGUAUUCCAUUUU-3' | (SEQ ID NO: 2881) |
| TTR-656 19 nt Target #3: 5'-AACCAAGAGUAUUCCAUUU-3' | (SEQ ID NO: 3265) |
| TTR-657 19 nt Target #1: 5'-CAAGAGUAUUCCAUUUUUA-3' | (SEQ ID NO: 2498) |
| TTR-657 19 nt Target #2: 5'-CCAAGAGUAUUCCAUUUUU-3' | (SEQ ID NO: 2882) |
| TTR-657 19 nt Target #3: 5'-ACCAAGAGUAUUCCAUUUU-3' | (SEQ ID NO: 3266) |
| TTR-658 19 nt Target #1: 5'-AAGAGUAUUCCAUUUUUAC-3' | (SEQ ID NO: 2499) |
| TTR-658 19 nt Target #2: 5'-CAAGAGUAUUCCAUUUUUA-3' | (SEQ ID NO: 2883) |
| TTR-658 19 nt Target #3: 5'-CCAAGAGUAUUCCAUUUUU-3' | (SEQ ID NO: 3267) |
| TTR-659 19 nt Target #1: 5'-AGAGUAUUCCAUUUUUACU-3' | (SEQ ID NO: 2500) |
| TTR-659 19 nt Target #2: 5'-AAGAGUAUUCCAUUUUUAC-3' | (SEQ ID NO: 2884) |

TABLE 6-continued

DsiRNA Component 19 Nucleotide Target Sequences in Transthyretin mRNA

| | | |
|---|---|---|
| TTR-659 19 nt Target #3: | 5'-CAAGAGUAUUCCAUUUUUA-3' | (SEQ ID NO: 3268) |
| TTR-660 19 nt Target #1: | 5'-GAGUAUUCCAUUUUUACUA-3' | (SEQ ID NO: 2501) |
| TTR-660 19 nt Target #2: | 5'-AGAGUAUUCCAUUUUUACU-3' | (SEQ ID NO: 2885) |
| TTR-660 19 nt Target #3: | 5'-AAGAGUAUUCCAUUUUUAC-3' | (SEQ ID NO: 3269) |
| TTR-661 19 nt Target #1: | 5'-AGUAUUCCAUUUUUACUAA-3' | (SEQ ID NO: 2502) |
| TTR-661 19 nt Target #2: | 5'-GAGUAUUCCAUUUUUACUA-3' | (SEQ ID NO: 2886) |
| TTR-661 19 nt Target #3: | 5'-AGAGUAUUCCAUUUUUACU-3' | (SEQ ID NO: 3270) |
| TTR-662 19 nt Target #1: | 5'-GUAUUCCAUUUUUACUAAA-3' | (SEQ ID NO: 2503) |
| TTR-662 19 nt Target #2: | 5'-AGUAUUCCAUUUUUACUAA-3' | (SEQ ID NO: 2887) |
| TTR-662 19 nt Target #3: | 5'-GAGUAUUCCAUUUUUACUA-3' | (SEQ ID NO: 3271) |
| TTR-663 19 nt Target #1: | 5'-UAUUCCAUUUUUACUAAAG-3' | (SEQ ID NO: 2504) |
| TTR-663 19 nt Target #2: | 5'-GUAUUCCAUUUUUACUAAA-3' | (SEQ ID NO: 2888) |
| TTR-663 19 nt Target #3: | 5'-AGUAUUCCAUUUUUACUAA-3' | (SEQ ID NO: 3272) |
| TTR-664 19 nt Target #1: | 5'-AUUCCAUUUUUACUAAAGC-3' | (SEQ ID NO: 2505) |
| TTR-664 19 nt Target #2: | 5'-UAUUCCAUUUUUACUAAAG-3' | (SEQ ID NO: 2889) |
| TTR-664 19 nt Target #3: | 5'-GUAUUCCAUUUUUACUAAA-3' | (SEQ ID NO: 3273) |
| TTR-665 19 nt Target #1: | 5'-UUCCAUUUUUACUAAAGCA-3' | (SEQ ID NO: 2506) |
| TTR-665 19 nt Target #2: | 5'-AUUCCAUUUUUACUAAAGC-3' | (SEQ ID NO: 2890) |
| TTR-665 19 nt Target #3: | 5'-UAUUCCAUUUUUACUAAAG-3' | (SEQ ID NO: 3274) |
| TTR-666 19 nt Target #1: | 5'-UCCAUUUUUACUAAAGCAG-3' | (SEQ ID NO: 2507) |
| TTR-666 19 nt Target #2: | 5'-UUCCAUUUUUACUAAAGCA-3' | (SEQ ID NO: 2891) |
| TTR-666 19 nt Target #3: | 5'-AUUCCAUUUUUACUAAAGC-3' | (SEQ ID NO: 3275) |
| TTR-667 19 nt Target #1: | 5'-CCAUUUUUACUAAAGCAGU-3' | (SEQ ID NO: 2508) |
| TTR-667 19 nt Target #2: | 5'-UCCAUUUUUACUAAAGCAG-3' | (SEQ ID NO: 2892) |
| TTR-667 19 nt Target #3: | 5'-UUCCAUUUUUACUAAAGCA-3' | (SEQ ID NO: 3276) |
| TTR-668 19 nt Target #1: | 5'-CAUUUUUACUAAAGCAGUG-3' | (SEQ ID NO: 2509) |
| TTR-668 19 nt Target #2: | 5'-CCAUUUUUACUAAAGCAGU-3' | (SEQ ID NO: 2893) |
| TTR-668 19 nt Target #3: | 5'-UCCAUUUUUACUAAAGCAG-3' | (SEQ ID NO: 3277) |
| TTR-669 19 nt Target #1: | 5'-AUUUUUACUAAAGCAGUGU-3' | (SEQ ID NO: 2510) |
| TTR-669 19 nt Target #2: | 5'-CAUUUUUACUAAAGCAGUG-3' | (SEQ ID NO: 2894) |
| TTR-669 19 nt Target #3: | 5'-CCAUUUUUACUAAAGCAGU-3' | (SEQ ID NO: 3278) |
| TTR-670 19 nt Target #1: | 5'-UUUUUACUAAAGCAGUGUU-3' | (SEQ ID NO: 2511) |
| TTR-670 19 nt Target #2: | 5'-AUUUUUACUAAAGCAGUGU-3' | (SEQ ID NO: 2895) |
| TTR-670 19 nt Target #3: | 5'-CAUUUUUACUAAAGCAGUG-3' | (SEQ ID NO: 3279) |
| TTR-671 19 nt Target #1: | 5'-UUUUACUAAAGCAGUGUUU-3' | (SEQ ID NO: 2512) |
| TTR-671 19 nt Target #2: | 5'-UUUUUACUAAAGCAGUGUU-3' | (SEQ ID NO: 2896) |
| TTR-671 19 nt Target #3: | 5'-AUUUUUACUAAAGCAGUGU-3' | (SEQ ID NO: 3280) |
| TTR-672 19 nt Target #1: | 5'-UUUACUAAAGCAGUGUUUU-3' | (SEQ ID NO: 2513) |

TABLE 6-continued

DsiRNA Component 19 Nucleotide Target Sequences in Transthyretin mRNA

| | | |
|---|---|---|
| TTR-672 19 nt Target #2: | 5'-UUUUACUAAAGCAGUGUUU-3' | (SEQ ID NO: 2897) |
| TTR-672 19 nt Target #3: | 5'-UUUUUACUAAAGCAGUGUU-3' | (SEQ ID NO: 3281) |
| TTR-673 19 nt Target #1: | 5'-UUACUAAAGCAGUGUUUUC-3' | (SEQ ID NO: 2514) |
| TTR-673 19 nt Target #2: | 5'-UUUACUAAAGCAGUGUUUU-3' | (SEQ ID NO: 2898) |
| TTR-673 19 nt Target #3: | 5'-UUUUACUAAAGCAGUGUUU-3' | (SEQ ID NO: 3282) |
| TTR-674 19 nt Target #1: | 5'-UACUAAAGCAGUGUUUUCA-3' | (SEQ ID NO: 2515) |
| TTR-674 19 nt Target #2: | 5'-UUACUAAAGCAGUGUUUUC-3' | (SEQ ID NO: 2899) |
| TTR-674 19 nt Target #3: | 5'-UUUACUAAAGCAGUGUUUU-3' | (SEQ ID NO: 3283) |
| TTR-675 19 nt Target #1: | 5'-ACUAAAGCAGUGUUUUCAC-3' | (SEQ ID NO: 2516) |
| TTR-675 19 nt Target #2: | 5'-UACUAAAGCAGUGUUUUCA-3' | (SEQ ID NO: 2900) |
| TTR-675 19 nt Target #3: | 5'-UUACUAAAGCAGUGUUUUC-3' | (SEQ ID NO: 3284) |
| TTR-676 19 nt Target #1: | 5'-CUAAAGCAGUGUUUUCACC-3' | (SEQ ID NO: 2517) |
| TTR-676 19 nt Target #2: | 5'-ACUAAAGCAGUGUUUUCAC-3' | (SEQ ID NO: 2901) |
| TTR-676 19 nt Target #3: | 5'-UACUAAAGCAGUGUUUUCA-3' | (SEQ ID NO: 3285) |
| TTR-677 19 nt Target #1: | 5'-UAAAGCAGUGUUUUCACCU-3' | (SEQ ID NO: 2518) |
| TTR-677 19 nt Target #2: | 5'-CUAAAGCAGUGUUUUCACC-3' | (SEQ ID NO: 2902) |
| TTR-677 19 nt Target #3: | 5'-ACUAAAGCAGUGUUUUCAC-3' | (SEQ ID NO: 3286) |
| TTR-678 19 nt Target #1: | 5'-AAAGCAGUGUUUUCACCUC-3' | (SEQ ID NO: 2519) |
| TTR-678 19 nt Target #2: | 5'-UAAAGCAGUGUUUUCACCU-3' | (SEQ ID NO: 2903) |
| TTR-678 19 nt Target #3: | 5'-CUAAAGCAGUGUUUUCACC-3' | (SEQ ID NO: 3287) |
| TTR-679 19 nt Target #1: | 5'-AAGCAGUGUUUUCACCUCA-3' | (SEQ ID NO: 2520) |
| TTR-679 19 nt Target #2: | 5'-AAAGCAGUGUUUUCACCUC-3' | (SEQ ID NO: 2904) |
| TTR-679 19 nt Target #3: | 5'-UAAAGCAGUGUUUUCACCU-3' | (SEQ ID NO: 3288) |
| TTR-680 19 nt Target #1: | 5'-AGCAGUGUUUUCACCUCAU-3' | (SEQ ID NO: 2521) |
| TTR-680 19 nt Target #2: | 5'-AAGCAGUGUUUUCACCUCA-3' | (SEQ ID NO: 2905) |
| TTR-680 19 nt Target #3: | 5'-AAAGCAGUGUUUUCACCUC-3' | (SEQ ID NO: 3289) |
| TTR-681 19 nt Target #1: | 5'-GCAGUGUUUUCACCUCAUA-3' | (SEQ ID NO: 2522) |
| TTR-681 19 nt Target #2: | 5'-AGCAGUGUUUUCACCUCAU-3' | (SEQ ID NO: 2906) |
| TTR-681 19 nt Target #3: | 5'-AAGCAGUGUUUUCACCUCA-3' | (SEQ ID NO: 3290) |
| TTR-682 19 nt Target #1: | 5'-CAGUGUUUUCACCUCAUAU-3' | (SEQ ID NO: 2523) |
| TTR-682 19 nt Target #2: | 5'-GCAGUGUUUUCACCUCAUA-3' | (SEQ ID NO: 2907) |
| TTR-682 19 nt Target #3: | 5'-AGCAGUGUUUUCACCUCAU-3' | (SEQ ID NO: 3291) |
| TTR-683 19 nt Target #1: | 5'-AGUGUUUUCACCUCAUAUG-3' | (SEQ ID NO: 2524) |
| TTR-683 19 nt Target #2: | 5'-CAGUGUUUUCACCUCAUAU-3' | (SEQ ID NO: 2908) |
| TTR-683 19 nt Target #3: | 5'-GCAGUGUUUUCACCUCAUA-3' | (SEQ ID NO: 3292) |
| TTR-684 19 nt Target #1: | 5'-GUGUUUUCACCUCAUAUGC-3' | (SEQ ID NO: 2525) |
| TTR-684 19 nt Target #2: | 5'-AGUGUUUUCACCUCAUAUG-3' | (SEQ ID NO: 2909) |
| TTR-684 19 nt Target #3: | 5'-CAGUGUUUUCACCUCAUAU-3' | (SEQ ID NO: 3293) |
| TTR-685 19 nt Target #1: | 5'-UGUUUUCACCUCAUAUGCU-3' | (SEQ ID NO: 2526) |

TABLE 6-continued

DsiRNA Component 19 Nucleotide Target Sequences in Transthyretin mRNA

```
TTR-685 19 nt Target #2: 5'-GUGUUUUCACCUCAUAUGC-3'  (SEQ ID NO: 2910)

TTR-685 19 nt Target #3: 5'-AGUGUUUUCACCUCAUAUG-3'  (SEQ ID NO: 3294)

TTR-686 19 nt Target #1: 5'-GUUUUCACCUCAUAUGCUA-3'  (SEQ ID NO: 2527)

TTR-686 19 nt Target #2: 5'-UGUUUUCACCUCAUAUGCU-3'  (SEQ ID NO: 2911)

TTR-686 19 nt Target #3: 5'-GUGUUUUCACCUCAUAUGC-3'  (SEQ ID NO: 3295)

TTR-687 19 nt Target #1: 5'-UUUUCACCUCAUAUGCUAU-3'  (SEQ ID NO: 2528)

TTR-687 19 nt Target #2: 5'-GUUUUCACCUCAUAUGCUA-3'  (SEQ ID NO: 2912)

TTR-687 19 nt Target #3: 5'-UGUUUUCACCUCAUAUGCU-3'  (SEQ ID NO: 3296)

TTR-688 19 nt Target #1: 5'-UUUCACCUCAUAUGCUAUG-3'  (SEQ ID NO: 2529)

TTR-688 19 nt Target #2: 5'-UUUUCACCUCAUAUGCUAU-3'  (SEQ ID NO: 2913)

TTR-688 19 nt Target #3: 5'-GUUUUCACCUCAUAUGCUA-3'  (SEQ ID NO: 3297)

TTR-689 19 nt Target #1: 5'-UUCACCUCAUAUGCUAUGU-3'  (SEQ ID NO: 2530)

TTR-689 19 nt Target #2: 5'-UUUCACCUCAUAUGCUAUG-3'  (SEQ ID NO: 2914)

TTR-689 19 nt Target #3: 5'-UUUUCACCUCAUAUGCUAU-3'  (SEQ ID NO: 3298)

TTR-690 19 nt Target #1: 5'-UCACCUCAUAUGCUAUGUU-3'  (SEQ ID NO: 2531)

TTR-690 19 nt Target #2: 5'-UUCACCUCAUAUGCUAUGU-3'  (SEQ ID NO: 2915)

TTR-690 19 nt Target #3: 5'-UUUCACCUCAUAUGCUAUG-3'  (SEQ ID NO: 3299)

TTR-691 19 nt Target #1: 5'-CACCUCAUAUGCUAUGUUA-3'  (SEQ ID NO: 2532)

TTR-691 19 nt Target #2: 5'-UCACCUCAUAUGCUAUGUU-3'  (SEQ ID NO: 2916)

TTR-691 19 nt Target #3: 5'-UUCACCUCAUAUGCUAUGU-3'  (SEQ ID NO: 3300)

TTR-692 19 nt Target #1: 5'-ACCUCAUAUGCUAUGUUAG-3'  (SEQ ID NO: 2533)

TTR-692 19 nt Target #2: 5'-CACCUCAUAUGCUAUGUUA-3'  (SEQ ID NO: 2917)

TTR-692 19 nt Target #3: 5'-UCACCUCAUAUGCUAUGUU-3'  (SEQ ID NO: 3301)

TTR-693 19 nt Target #1: 5'-CCUCAUAUGCUAUGUUAGA-3'  (SEQ ID NO: 2534)

TTR-693 19 nt Target #2: 5'-ACCUCAUAUGCUAUGUUAG-3'  (SEQ ID NO: 2918)

TTR-693 19 nt Target #3: 5'-CACCUCAUAUGCUAUGUUA-3'  (SEQ ID NO: 3302)

TTR-694 19 nt Target #1: 5'-CUCAUAUGCUAUGUUAGAA-3'  (SEQ ID NO: 2535)

TTR-694 19 nt Target #2: 5'-CCUCAUAUGCUAUGUUAGA-3'  (SEQ ID NO: 2919)

TTR-694 19 nt Target #3: 5'-ACCUCAUAUGCUAUGUUAG-3'  (SEQ ID NO: 3303)

TTR-695 19 nt Target #1: 5'-UCAUAUGCUAUGUUAGAAG-3'  (SEQ ID NO: 2536)

TTR-695 19 nt Target #2: 5'-CUCAUAUGCUAUGUUAGAA-3'  (SEQ ID NO: 2920)

TTR-695 19 nt Target #3: 5'-CCUCAUAUGCUAUGUUAGA-3'  (SEQ ID NO: 3304)

TTR-696 19 nt Target #1: 5'-CAUAUGCUAUGUUAGAAGU-3'  (SEQ ID NO: 2537)

TTR-696 19 nt Target #2: 5'-UCAUAUGCUAUGUUAGAAG-3'  (SEQ ID NO: 2921)

TTR-696 19 nt Target #3: 5'-CUCAUAUGCUAUGUUAGAA-3'  (SEQ ID NO: 3305)

TTR-697 19 nt Target #1: 5'-AUAUGCUAUGUUAGAAGUC-3'  (SEQ ID NO: 2538)

TTR-697 19 nt Target #2: 5'-CAUAUGCUAUGUUAGAAGU-3'  (SEQ ID NO: 2922)

TTR-697 19 nt Target #3: 5'-UCAUAUGCUAUGUUAGAAG-3'  (SEQ ID NO: 3306)
```

TABLE 6-continued

DsiRNA Component 19 Nucleotide Target Sequences in Transthyretin mRNA

| | | |
|---|---|---|
| TTR-698 19 nt Target #1: | 5'-UAUGCUAUGUUAGAAGUCC-3' | (SEQ ID NO: 2539) |
| TTR-698 19 nt Target #2: | 5'-AUAUGCUAUGUUAGAAGUC-3' | (SEQ ID NO: 2923) |
| TTR-698 19 nt Target #3: | 5'-CAUAUGCUAUGUUAGAAGU-3' | (SEQ ID NO: 3307) |
| TTR-699 19 nt Target #1: | 5'-AUGCUAUGUUAGAAGUCCA-3' | (SEQ ID NO: 2540) |
| TTR-699 19 nt Target #2: | 5'-UAUGCUAUGUUAGAAGUCC-3' | (SEQ ID NO: 2924) |
| TTR-699 19 nt Target #3: | 5'-AUAUGCUAUGUUAGAAGUC-3' | (SEQ ID NO: 3308) |
| TTR-702 19 nt Target #1: | 5'-CUAUGUUAGAAGUCCAGGC-3' | (SEQ ID NO: 2541) |
| TTR-702 19 nt Target #2: | 5'-GCUAUGUUAGAAGUCCAGG-3' | (SEQ ID NO: 2925) |
| TTR-702 19 nt Target #3: | 5'-UGCUAUGUUAGAAGUCCAG-3' | (SEQ ID NO: 3309) |
| TTR-704 19 nt Target #1: | 5'-AUGUUAGAAGUCCAGGCAG-3' | (SEQ ID NO: 2542) |
| TTR-704 19 nt Target #2: | 5'-UAUGUUAGAAGUCCAGGCA-3' | (SEQ ID NO: 2926) |
| TTR-704 19 nt Target #3: | 5'-CUAUGUUAGAAGUCCAGGC-3' | (SEQ ID NO: 3310) |
| TTR-705 19 nt Target #1: | 5'-UGUUAGAAGUCCAGGCAGA-3' | (SEQ ID NO: 2543) |
| TTR-705 19 nt Target #2: | 5'-AUGUUAGAAGUCCAGGCAG-3' | (SEQ ID NO: 2927) |
| TTR-705 19 nt Target #3: | 5'-UAUGUUAGAAGUCCAGGCA-3' | (SEQ ID NO: 3311) |
| TTR-706 19 nt Target #1: | 5'-GUUAGAAGUCCAGGCAGAG-3' | (SEQ ID NO: 2544) |
| TTR-706 19 nt Target #2: | 5'-UGUUAGAAGUCCAGGCAGA-3' | (SEQ ID NO: 2928) |
| TTR-706 19 nt Target #3: | 5'-AUGUUAGAAGUCCAGGCAG-3' | (SEQ ID NO: 3312) |
| TTR-707 19 nt Target #1: | 5'-UUAGAAGUCCAGGCAGAGA-3' | (SEQ ID NO: 2545) |
| TTR-707 19 nt Target #2: | 5'-GUUAGAAGUCCAGGCAGAG-3' | (SEQ ID NO: 2929) |
| TTR-707 19 nt Target #3: | 5'-UGUUAGAAGUCCAGGCAGA-3' | (SEQ ID NO: 3313) |
| TTR-708 19 nt Target #1: | 5'-UAGAAGUCCAGGCAGAGAC-3' | (SEQ ID NO: 2546) |
| TTR-708 19 nt Target #2: | 5'-UUAGAAGUCCAGGCAGAGA-3' | (SEQ ID NO: 2930) |
| TTR-708 19 nt Target #3: | 5'-GUUAGAAGUCCAGGCAGAG-3' | (SEQ ID NO: 3314) |
| TTR-709 19 nt Target #1: | 5'-AGAAGUCCAGGCAGAGACA-3' | (SEQ ID NO: 2547) |
| TTR-709 19 nt Target #2: | 5'-UAGAAGUCCAGGCAGAGAC-3' | (SEQ ID NO: 2931) |
| TTR-709 19 nt Target #3: | 5'-UUAGAAGUCCAGGCAGAGA-3' | (SEQ ID NO: 3315) |
| TTR-710 19 nt Target #1: | 5'-GAAGUCCAGGCAGAGACAA-3' | (SEQ ID NO: 2548) |
| TTR-710 19 nt Target #2: | 5'-AGAAGUCCAGGCAGAGACA-3' | (SEQ ID NO: 2932) |
| TTR-710 19 nt Target #3: | 5'-UAGAAGUCCAGGCAGAGAC-3' | (SEQ ID NO: 3316) |
| TTR-711 19 nt Target #1: | 5'-AAGUCCAGGCAGAGACAAU-3' | (SEQ ID NO: 2549) |
| TTR-711 19 nt Target #2: | 5'-GAAGUCCAGGCAGAGACAA-3' | (SEQ ID NO: 2933) |
| TTR-711 19 nt Target #3: | 5'-AGAAGUCCAGGCAGAGACA-3' | (SEQ ID NO: 3317) |
| TTR-712 19 nt Target #1: | 5'-AGUCCAGGCAGAGACAAUA-3' | (SEQ ID NO: 2550) |
| TTR-712 19 nt Target #2: | 5'-AAGUCCAGGCAGAGACAAU-3' | (SEQ ID NO: 2934) |
| TTR-712 19 nt Target #3: | 5'-GAAGUCCAGGCAGAGACAA-3' | (SEQ ID NO: 3318) |
| TTR-713 19 nt Target #1: | 5'-GUCCAGGCAGAGACAAUAA-3' | (SEQ ID NO: 2551) |
| TTR-713 19 nt Target #2: | 5'-AGUCCAGGCAGAGACAAUA-3' | (SEQ ID NO: 2935) |
| TTR-713 19 nt Target #3: | 5'-AAGUCCAGGCAGAGACAAU-3' | (SEQ ID NO: 3319) |

TABLE 6-continued

DsiRNA Component 19 Nucleotide Target Sequences in Transthyretin mRNA

| | | |
|---|---|---|
| TTR-714 19 nt Target #1: | 5'-UCCAGGCAGAGACAAUAAA-3' | (SEQ ID NO: 2552) |
| TTR-714 19 nt Target #2: | 5'-GUCCAGGCAGAGACAAUAA-3' | (SEQ ID NO: 2936) |
| TTR-714 19 nt Target #3: | 5'-AGUCCAGGCAGAGACAAUA-3' | (SEQ ID NO: 3320) |
| TTR-716 19 nt Target #1: | 5'-CAGGCAGAGACAAUAAAAC-3' | (SEQ ID NO: 2553) |
| TTR-716 19 nt Target #2: | 5'-CCAGGCAGAGACAAUAAAA-3' | (SEQ ID NO: 2937) |
| TTR-716 19 nt Target #3: | 5'-UCCAGGCAGAGACAAUAAA-3' | (SEQ ID NO: 3321) |
| TTR-717 19 nt Target #1: | 5'-AGGCAGAGACAAUAAAACA-3' | (SEQ ID NO: 2554) |
| TTR-717 19 nt Target #2: | 5'-CAGGCAGAGACAAUAAAAC-3' | (SEQ ID NO: 2938) |
| TTR-717 19 nt Target #3: | 5'-CCAGGCAGAGACAAUAAAA-3' | (SEQ ID NO: 3322) |
| TTR-718 19 nt Target #1: | 5'-GGCAGAGACAAUAAAACAU-3' | (SEQ ID NO: 2555) |
| TTR-718 19 nt Target #2: | 5'-AGGCAGAGACAAUAAAACA-3' | (SEQ ID NO: 2939) |
| TTR-718 19 nt Target #3: | 5'-CAGGCAGAGACAAUAAAAC-3' | (SEQ ID NO: 3323) |
| TTR-719 19 nt Target #1: | 5'-GCAGAGACAAUAAAACAUU-3' | (SEQ ID NO: 2556) |
| TTR-719 19 nt Target #2: | 5'-GGCAGAGACAAUAAAACAU-3' | (SEQ ID NO: 2940) |
| TTR-719 19 nt Target #3: | 5'-AGGCAGAGACAAUAAAACA-3' | (SEQ ID NO: 3324) |
| TTR-720 19 nt Target #1: | 5'-CAGAGACAAUAAAACAUUC-3' | (SEQ ID NO: 2557) |
| TTR-720 19 nt Target #2: | 5'-GCAGAGACAAUAAAACAUU-3' | (SEQ ID NO: 2941) |
| TTR-720 19 nt Target #3: | 5'-GGCAGAGACAAUAAAACAU-3' | (SEQ ID NO: 3325) |
| TTR-721 19 nt Target #1: | 5'-AGAGACAAUAAAACAUUCC-3' | (SEQ ID NO: 2558) |
| TTR-721 19 nt Target #2: | 5'-CAGAGACAAUAAAACAUUC-3' | (SEQ ID NO: 2942) |
| TTR-721 19 nt Target #3: | 5'-GCAGAGACAAUAAAACAUU-3' | (SEQ ID NO: 3326) |
| TTR-722 19 nt Target #1: | 5'-GAGACAAUAAAACAUUCCU-3' | (SEQ ID NO: 2559) |
| TTR-722 19 nt Target #2: | 5'-AGAGACAAUAAAACAUUCC-3' | (SEQ ID NO: 2943) |
| TTR-722 19 nt Target #3: | 5'-CAGAGACAAUAAAACAUUC-3' | (SEQ ID NO: 3327) |
| TTR-723 19 nt Target #1: | 5'-AGACAAUAAAACAUUCCUG-3' | (SEQ ID NO: 2560) |
| TTR-723 19 nt Target #2: | 5'-GAGACAAUAAAACAUUCCU-3' | (SEQ ID NO: 2944) |
| TTR-723 19 nt Target #3: | 5'-AGAGACAAUAAAACAUUCC-3' | (SEQ ID NO: 3328) |
| TTR-724 19 nt Target #1: | 5'-GACAAUAAAACAUUCCUGU-3' | (SEQ ID NO: 2561) |
| TTR-724 19 nt Target #2: | 5'-AGACAAUAAAACAUUCCUG-3' | (SEQ ID NO: 2945) |
| TTR-724 19 nt Target #3: | 5'-GAGACAAUAAAACAUUCCU-3' | (SEQ ID NO: 3329) |
| TTR-725 19 nt Target #1: | 5'-ACAAUAAAACAUUCCUGUG-3' | (SEQ ID NO: 2562) |
| TTR-725 19 nt Target #2: | 5'-GACAAUAAAACAUUCCUGU-3' | (SEQ ID NO: 2946) |
| TTR-725 19 nt Target #3: | 5'-AGACAAUAAAACAUUCCUG-3' | (SEQ ID NO: 3330) |
| TTR-726 19 nt Target #1: | 5'-CAAUAAAACAUUCCUGUGA-3' | (SEQ ID NO: 2563) |
| TTR-726 19 nt Target #2: | 5'-ACAAUAAAACAUUCCUGUG-3' | (SEQ ID NO: 2947) |
| TTR-726 19 nt Target #3: | 5'-GACAAUAAAACAUUCCUGU-3' | (SEQ ID NO: 3331) |
| TTR-727 19 nt Target #1: | 5'-AAUAAAACAUUCCUGUGAA-3' | (SEQ ID NO: 2564) |
| TTR-727 19 nt Target #2: | 5'-CAAUAAAACAUUCCUGUGA-3' | (SEQ ID NO: 2948) |

TABLE 6-continued

DsiRNA Component 19 Nucleotide Target Sequences in Transthyretin mRNA

TTR-727 19 nt Target #3: 5'-ACAAUAAAACAUUCCUGUG-3' (SEQ ID NO: 3332)

TTR-728 19 nt Target #1: 5'-AUAAAACAUUCCUGUGAAA-3' (SEQ ID NO: 2565)

TTR-728 19 nt Target #2: 5'-AAUAAAACAUUCCUGUGAA-3' (SEQ ID NO: 2949)

TTR-728 19 nt Target #3: 5'-CAAUAAAACAUUCCUGUGA-3' (SEQ ID NO: 3333)

TTR-731 19 nt Target #1: 5'-AAACAUUCCUGUGAAAGGC-3' (SEQ ID NO: 2566)

TTR-731 19 nt Target #2: 5'-AAAACAUUCCUGUGAAAGG-3' (SEQ ID NO: 2950)

TTR-731 19 nt Target #3: 5'-UAAAACAUUCCUGUGAAAG-3' (SEQ ID NO: 3334)

TTR-732 19 nt Target #1: 5'-AACAUUCCUGUGAAAGGCA-3' (SEQ ID NO: 2567)

TTR-732 19 nt Target #2: 5'-AAACAUUCCUGUGAAAGGC-3' (SEQ ID NO: 2951)

TTR-732 19 nt Target #3: 5'-AAAACAUUCCUGUGAAAGG-3' (SEQ ID NO: 3335)

TTR-733 19 nt Target #1: 5'-ACAUUCCUGUGAAAGGCAC-3' (SEQ ID NO: 2568)

TTR-733 19 nt Target #2: 5'-AACAUUCCUGUGAAAGGCA-3' (SEQ ID NO: 2952)

TTR-733 19 nt Target #3: 5'-AAACAUUCCUGUGAAAGGC-3' (SEQ ID NO: 3336)

TTR-734 19 nt Target #1: 5'-CAUUCCUGUGAAAGGCACU-3' (SEQ ID NO: 2569)

TTR-734 19 nt Target #2: 5'-ACAUUCCUGUGAAAGGCAC-3' (SEQ ID NO: 2953)

TTR-734 19 nt Target #3: 5'-AACAUUCCUGUGAAAGGCA-3' (SEQ ID NO: 3337)

TTR-735 19 nt Target #1: 5'-AUUCCUGUGAAAGGCACUU-3' (SEQ ID NO: 2570)

TTR-735 19 nt Target #2: 5'-CAUUCCUGUGAAAGGCACU-3' (SEQ ID NO: 2954)

TTR-735 19 nt Target #3: 5'-ACAUUCCUGUGAAAGGCAC-3' (SEQ ID NO: 3338)

TTR-736 19 nt Target #1: 5'-UUCCUGUGAAAGGCACUUU-3' (SEQ ID NO: 2571)

TTR-736 19 nt Target #2: 5'-AUUCCUGUGAAAGGCACUU-3' (SEQ ID NO: 2955)

TTR-736 19 nt Target #3: 5'-CAUUCCUGUGAAAGGCACU-3' (SEQ ID NO: 3339)

TTR-738 19 nt Target #1: 5'-CCUGUGAAAGGCACUUUUC-3' (SEQ ID NO: 2572)

TTR-738 19 nt Target #2: 5'-UCCUGUGAAAGGCACUUUU-3' (SEQ ID NO: 2956)

TTR-738 19 nt Target #3: 5'-UUCCUGUGAAAGGCACUUU-3' (SEQ ID NO: 3340)

TTR-739 19 nt Target #1: 5'-CUGUGAAAGGCACUUUUCA-3' (SEQ ID NO: 2573)

TTR-739 19 nt Target #2: 5'-CCUGUGAAAGGCACUUUUC-3' (SEQ ID NO: 2957)

TTR-739 19 nt Target #3: 5'-UCCUGUGAAAGGCACUUUU-3' (SEQ ID NO: 3341)

TTR-740 19 nt Target #1: 5'-UGUGAAAGGCACUUUUCAU-3' (SEQ ID NO: 2574)

TTR-740 19 nt Target #2: 5'-CUGUGAAAGGCACUUUUCA-3' (SEQ ID NO: 2958)

TTR-740 19 nt Target #3: 5'-CCUGUGAAAGGCACUUUUC-3' (SEQ ID NO: 3342)

TTR-741 19 nt Target #1: 5'-GUGAAAGGCACUUUUCAUU-3' (SEQ ID NO: 2575)

TTR-741 19 nt Target #2: 5'-UGUGAAAGGCACUUUUCAU-3' (SEQ ID NO: 2959)

TTR-741 19 nt Target #3: 5'-CUGUGAAAGGCACUUUUCA-3' (SEQ ID NO: 3343)

TTR-742 19 nt Target #1: 5'-UGAAAGGCACUUUUCAUUC-3' (SEQ ID NO: 2576)

TTR-742 19 nt Target #2: 5'-GUGAAAGGCACUUUUCAUU-3' (SEQ ID NO: 2960)

TTR-742 19 nt Target #3: 5'-UGUGAAAGGCACUUUUCAU-3' (SEQ ID NO: 3344)

TTR-743 19 nt Target #1: 5'-GAAAGGCACUUUUCAUUCC-3' (SEQ ID NO: 2577)

TTR-743 19 nt Target #2: 5'-UGAAAGGCACUUUUCAUUC-3' (SEQ ID NO: 2961)

TABLE 6-continued

DsiRNA Component 19 Nucleotide Target Sequences in Transthyretin mRNA

```
TTR-743 19 nt Target #3: 5'-GUGAAAGGCACUUUUCAUU-3'  (SEQ ID NO: 3345)
TTR-744 19 nt Target #1: 5'-AAAGGCACUUUUCAUUCCA-3'  (SEQ ID NO: 2578)
TTR-744 19 nt Target #2: 5'-GAAAGGCACUUUUCAUUCC-3'  (SEQ ID NO: 2962)
TTR-744 19 nt Target #3: 5'-UGAAAGGCACUUUUCAUUC-3'  (SEQ ID NO: 3346)
TTR-745 19 nt Target #1: 5'-AAGGCACUUUUCAUUCCAC-3'  (SEQ ID NO: 2579)
TTR-745 19 nt Target #2: 5'-AAAGGCACUUUUCAUUCCA-3'  (SEQ ID NO: 2963)
TTR-745 19 nt Target #3: 5'-GAAAGGCACUUUUCAUUCC-3'  (SEQ ID NO: 3347)
TTR-746 19 nt Target #1: 5'-AGGCACUUUUCAUUCCACU-3'  (SEQ ID NO: 2580)
TTR-746 19 nt Target #2: 5'-AAGGCACUUUUCAUUCCAC-3'  (SEQ ID NO: 2964)
TTR-746 19 nt Target #3: 5'-AAAGGCACUUUUCAUUCCA-3'  (SEQ ID NO: 3348)
TTR-747 19 nt Target #1: 5'-GGCACUUUUCAUUCCACUU-3'  (SEQ ID NO: 2581)
TTR-747 19 nt Target #2: 5'-AGGCACUUUUCAUUCCACU-3'  (SEQ ID NO: 2965)
TTR-747 19 nt Target #3: 5'-AAGGCACUUUUCAUUCCAC-3'  (SEQ ID NO: 3349)
TTR-748 19 nt Target #1: 5'-GCACUUUUCAUUCCACUUU-3'  (SEQ ID NO: 2582)
TTR-748 19 nt Target #2: 5'-GGCACUUUUCAUUCCACUU-3'  (SEQ ID NO: 2966)
TTR-748 19 nt Target #3: 5'-AGGCACUUUUCAUUCCACU-3'  (SEQ ID NO: 3350)
TTR-749 19 nt Target #1: 5'-CACUUUUCAUUCCACUUUA-3'  (SEQ ID NO: 2583)
TTR-749 19 nt Target #2: 5'-GCACUUUUCAUUCCACUUU-3'  (SEQ ID NO: 2967)
TTR-749 19 nt Target #3: 5'-GGCACUUUUCAUUCCACUU-3'  (SEQ ID NO: 3351)
TTR-750 19 nt Target #1: 5'-ACUUUUCAUUCCACUUUAA-3'  (SEQ ID NO: 2584)
TTR-750 19 nt Target #2: 5'-CACUUUUCAUUCCACUUUA-3'  (SEQ ID NO: 2968)
TTR-750 19 nt Target #3: 5'-GCACUUUUCAUUCCACUUU-3'  (SEQ ID NO: 3352)
TTR-751 19 nt Target #1: 5'-CUUUUCAUUCCACUUUAAC-3'  (SEQ ID NO: 2585)
TTR-751 19 nt Target #2: 5'-ACUUUUCAUUCCACUUUAA-3'  (SEQ ID NO: 2969)
TTR-751 19 nt Target #3: 5'-CACUUUUCAUUCCACUUUA-3'  (SEQ ID NO: 3353)
TTR-752 19 nt Target #1: 5'-UUUUCAUUCCACUUUAACU-3'  (SEQ ID NO: 2586)
TTR-752 19 nt Target #2: 5'-CUUUUCAUUCCACUUUAAC-3'  (SEQ ID NO: 2970)
TTR-752 19 nt Target #3: 5'-ACUUUUCAUUCCACUUUAA-3'  (SEQ ID NO: 3354)
TTR-753 19 nt Target #1: 5'-UUUCAUUCCACUUUAACUU-3'  (SEQ ID NO: 2587)
TTR-753 19 nt Target #2: 5'-UUUUCAUUCCACUUUAACU-3'  (SEQ ID NO: 2971)
TTR-753 19 nt Target #3: 5'-CUUUUCAUUCCACUUUAAC-3'  (SEQ ID NO: 3355)
TTR-754 19 nt Target #1: 5'-UUCAUUCCACUUUAACUUG-3'  (SEQ ID NO: 2588)
TTR-754 19 nt Target #2: 5'-UUUCAUUCCACUUUAACUU-3'  (SEQ ID NO: 2972)
TTR-754 19 nt Target #3: 5'-UUUUCAUUCCACUUUAACU-3'  (SEQ ID NO: 3356)
TTR-755 19 nt Target #1: 5'-UCAUUCCACUUUAACUUGA-3'  (SEQ ID NO: 2589)
TTR-755 19 nt Target #2: 5'-UUCAUUCCACUUUAACUUG-3'  (SEQ ID NO: 2973)
TTR-755 19 nt Target #3: 5'-UUUCAUUCCACUUUAACUU-3'  (SEQ ID NO: 3357)
TTR-756 19 nt Target #1: 5'-CAUUCCACUUUAACUUGAU-3'  (SEQ ID NO: 2590)
```

TABLE 6-continued

DsiRNA Component 19 Nucleotide Target Sequences in Transthyretin mRNA

TTR-756 19 nt Target #2: 5'-UCAUUCCACUUUAACUUGA-3' (SEQ ID NO: 2974)

TTR-756 19 nt Target #3: 5'-UUCAUUCCACUUUAACUUG-3' (SEQ ID NO: 3358)

TTR-757 19 nt Target #1: 5'-AUUCCACUUUAACUUGAUU-3' (SEQ ID NO: 2591)

TTR-757 19 nt Target #2: 5'-CAUUCCACUUUAACUUGAU-3' (SEQ ID NO: 2975)

TTR-757 19 nt Target #3: 5'-UCAUUCCACUUUAACUUGA-3' (SEQ ID NO: 3359)

TTR-758 19 nt Target #1: 5'-UUCCACUUUAACUUGAUUU-3' (SEQ ID NO: 2592)

TTR-758 19 nt Target #2: 5'-AUUCCACUUUAACUUGAUU-3' (SEQ ID NO: 2976)

TTR-758 19 nt Target #3: 5'-CAUUCCACUUUAACUUGAU-3' (SEQ ID NO: 3360)

TTR-759 19 nt Target #1: 5'-UCCACUUUAACUUGAUUUU-3' (SEQ ID NO: 2593)

TTR-759 19 nt Target #2: 5'-UUCCACUUUAACUUGAUUU-3' (SEQ ID NO: 2977)

TTR-759 19 nt Target #3: 5'-AUUCCACUUUAACUUGAUU-3' (SEQ ID NO: 3361)

TTR-760 19 nt Target #1: 5'-CCACUUUAACUUGAUUUUU-3' (SEQ ID NO: 2594)

TTR-760 19 nt Target #2: 5'-UCCACUUUAACUUGAUUUU-3' (SEQ ID NO: 2978)

TTR-760 19 nt Target #3: 5'-UUCCACUUUAACUUGAUUU-3' (SEQ ID NO: 3362)

TTR-761 19 nt Target #1: 5'-CACUUUAACUUGAUUUUUU-3' (SEQ ID NO: 2595)

TTR-761 19 nt Target #2: 5'-CCACUUUAACUUGAUUUUU-3' (SEQ ID NO: 2979)

TTR-761 19 nt Target #3: 5'-UCCACUUUAACUUGAUUUU-3' (SEQ ID NO: 3363)

TTR-762 19 nt Target #1: 5'-ACUUUAACUUGAUUUUUUA-3' (SEQ ID NO: 2596)

TTR-762 19 nt Target #2: 5'-CACUUUAACUUGAUUUUUU-3' (SEQ ID NO: 2980)

TTR-762 19 nt Target #3: 5'-CCACUUUAACUUGAUUUUU-3' (SEQ ID NO: 3364)

TTR-763 19 nt Target #1: 5'-CUUUAACUUGAUUUUUUAA-3' (SEQ ID NO: 2597)

TTR-763 19 nt Target #2: 5'-ACUUUAACUUGAUUUUUUA-3' (SEQ ID NO: 2981)

TTR-763 19 nt Target #3: 5'-CACUUUAACUUGAUUUUUU-3' (SEQ ID NO: 3365)

TTR-764 19 nt Target #1: 5'-UUUAACUUGAUUUUUUAAA-3' (SEQ ID NO: 2598)

TTR-764 19 nt Target #2: 5'-CUUUAACUUGAUUUUUUAA-3' (SEQ ID NO: 2982)

TTR-764 19 nt Target #3: 5'-ACUUUAACUUGAUUUUUUA-3' (SEQ ID NO: 3366)

TTR-765 19 nt Target #1: 5'-UUAACUUGAUUUUUUAAAU-3' (SEQ ID NO: 2599)

TTR-765 19 nt Target #2: 5'-UUUAACUUGAUUUUUUAAA-3' (SEQ ID NO: 2983)

TTR-765 19 nt Target #3: 5'-CUUUAACUUGAUUUUUUAA-3' (SEQ ID NO: 3367)

TTR-766 19 nt Target #1: 5'-UAACUUGAUUUUUUAAAUU-3' (SEQ ID NO: 2600)

TTR-766 19 nt Target #2: 5'-UUAACUUGAUUUUUUAAAU-3' (SEQ ID NO: 2984)

TTR-766 19 nt Target #3: 5'-UUUAACUUGAUUUUUUAAA-3' (SEQ ID NO: 3368)

TTR-767 19 nt Target #1: 5'-AACUUGAUUUUUUAAAUUC-3' (SEQ ID NO: 2601)

TTR-767 19 nt Target #2: 5'-UAACUUGAUUUUUUAAAUU-3' (SEQ ID NO: 2985)

TTR-767 19 nt Target #3: 5'-UUAACUUGAUUUUUUAAAU-3' (SEQ ID NO: 3369)

TTR-768 19 nt Target #1: 5'-ACUUGAUUUUUUAAAUUCC-3' (SEQ ID NO: 2602)

TTR-768 19 nt Target #2: 5'-AACUUGAUUUUUUAAAUUC-3' (SEQ ID NO: 2986)

TTR-768 19 nt Target #3: 5'-UAACUUGAUUUUUUAAAUU-3' (SEQ ID NO: 3370)

TTR-769 19 nt Target #1: 5'-CUUGAUUUUUUAAAUUCCC-3' (SEQ ID NO: 2603)

TABLE 6-continued

DsiRNA Component 19 Nucleotide Target Sequences in Transthyretin mRNA

TTR-769 19 nt Target #2: 5'-ACUUGAUUUUUAAAUUCC-3'  (SEQ ID NO: 2987)

TTR-769 19 nt Target #3: 5'-AACUUGAUUUUUAAAUUC-3'  (SEQ ID NO: 3371)

TTR-770 19 nt Target #1: 5'-UUGAUUUUUAAAUUCCCU-3'  (SEQ ID NO: 2604)

TTR-770 19 nt Target #2: 5'-CUUGAUUUUUAAAUUCCC-3'  (SEQ ID NO: 2988)

TTR-770 19 nt Target #3: 5'-ACUUGAUUUUUAAAUUCC-3'  (SEQ ID NO: 3372)

TTR-771 19 nt Target #1: 5'-UGAUUUUUAAAUUCCCUU-3'  (SEQ ID NO: 2605)

TTR-771 19 nt Target #2: 5'-UUGAUUUUUAAAUUCCCU-3'  (SEQ ID NO: 2989)

TTR-771 19 nt Target #3: 5'-CUUGAUUUUUAAAUUCCC-3'  (SEQ ID NO: 3373)

TTR-772 19 nt Target #1: 5'-GAUUUUUAAAUUCCCUUA-3'  (SEQ ID NO: 2606)

TTR-772 19 nt Target #2: 5'-UGAUUUUUAAAUUCCCUU-3'  (SEQ ID NO: 2990)

TTR-772 19 nt Target #3: 5'-UUGAUUUUUAAAUUCCCU-3'  (SEQ ID NO: 3374)

TTR-773 19 nt Target #1: 5'-AUUUUUAAAUUCCCUUAU-3'  (SEQ ID NO: 2607)

TTR-773 19 nt Target #2: 5'-GAUUUUUAAAUUCCCUUA-3'  (SEQ ID NO: 2991)

TTR-773 19 nt Target #3: 5'-UGAUUUUUAAAUUCCCUU-3'  (SEQ ID NO: 3375)

TTR-775 19 nt Target #1: 5'-UUUUUAAAUUCCCUUAUUG-3'  (SEQ ID NO: 2608)

TTR-775 19 nt Target #2: 5'-UUUUUUAAAUUCCCUUAUU-3'  (SEQ ID NO: 2992)

TTR-775 19 nt Target #3: 5'-AUUUUUUAAAUUCCCUUAU-3'  (SEQ ID NO: 3376)

TTR-780 19 nt Target #1: 5'-AAAUUCCCUUAUUGUCCCU-3'  (SEQ ID NO: 2609)

TTR-780 19 nt Target #2: 5'-UAAAUUCCCUUAUUGUCCC-3'  (SEQ ID NO: 2993)

TTR-780 19 nt Target #3: 5'-UUAAAUUCCCUUAUUGUCC-3'  (SEQ ID NO: 3377)

TTR-781 19 nt Target #1: 5'-AAUUCCCUUAUUGUCCCUU-3'  (SEQ ID NO: 2610)

TTR-781 19 nt Target #2: 5'-AAAUUCCCUUAUUGUCCCU-3'  (SEQ ID NO: 2994)

TTR-781 19 nt Target #3: 5'-UAAAUUCCCUUAUUGUCCC-3'  (SEQ ID NO: 3378)

TTR-784 19 nt Target #1: 5'-UCCCUUAUUGUCCCUUCCA-3'  (SEQ ID NO: 2611)

TTR-784 19 nt Target #2: 5'-UUCCCUUAUUGUCCCUUCC-3'  (SEQ ID NO: 2995)

TTR-784 19 nt Target #3: 5'-AUUCCCUUAUUGUCCCUUC-3'  (SEQ ID NO: 3379)

TTR-805 19 nt Target #1: 5'-AAAAGAGAAUCAAAAUUU-3'  (SEQ ID NO: 2612)

TTR-805 19 nt Target #2: 5'-AAAAAGAGAAUCAAAAUU-3'  (SEQ ID NO: 2996)

TTR-805 19 nt Target #3: 5'-AAAAAAGAGAAUCAAAAU-3'  (SEQ ID NO: 3380)

TTR-806 19 nt Target #1: 5'-AAAGAGAAUCAAAAUUUU-3'  (SEQ ID NO: 2613)

TTR-806 19 nt Target #2: 5'-AAAAGAGAAUCAAAAUUU-3'  (SEQ ID NO: 2997)

TTR-806 19 nt Target #3: 5'-AAAAAGAGAAUCAAAAUU-3'  (SEQ ID NO: 3381)

TTR-807 19 nt Target #1: 5'-AAGAGAAUCAAAAUUUUA-3'  (SEQ ID NO: 2614)

TTR-807 19 nt Target #2: 5'-AAAGAGAAUCAAAAUUUU-3'  (SEQ ID NO: 2998)

TTR-807 19 nt Target #3: 5'-AAAAGAGAAUCAAAAUUU-3'  (SEQ ID NO: 3382)

TTR-808 19 nt Target #1: 5'-AGAGAAUCAAAAUUUUAC-3'  (SEQ ID NO: 2615)

TTR-808 19 nt Target #2: 5'-AAGAGAAUCAAAAUUUUA-3'  (SEQ ID NO: 2999)

TTR-808 19 nt Target #3: 5'-AAAGAGAAUCAAAAUUUU-3'  (SEQ ID NO: 3383)

TABLE 6-continued

DsiRNA Component 19 Nucleotide Target Sequences in Transthyretin mRNA

| | | |
|---|---|---|
| TTR-809 19 nt Target #1: | 5'-AGAGAAUCAAAAUUUUACA-3' | (SEQ ID NO: 2616) |
| TTR-809 19 nt Target #2: | 5'-AAGAGAAUCAAAAUUUUAC-3' | (SEQ ID NO: 3000) |
| TTR-809 19 nt Target #3: | 5'-AAAGAGAAUCAAAAUUUUA-3' | (SEQ ID NO: 3384) |
| TTR-810 19 nt Target #1: | 5'-GAGAAUCAAAAUUUUACAA-3' | (SEQ ID NO: 2617) |
| TTR-810 19 nt Target #2: | 5'-AGAGAAUCAAAAUUUUACA-3' | (SEQ ID NO: 3001) |
| TTR-810 19 nt Target #3: | 5'-AAGAGAAUCAAAAUUUUAC-3' | (SEQ ID NO: 3385) |
| TTR-811 19 nt Target #1: | 5'-AGAAUCAAAAUUUUACAAA-3' | (SEQ ID NO: 2618) |
| TTR-811 19 nt Target #2: | 5'-GAGAAUCAAAAUUUUACAA-3' | (SEQ ID NO: 3002) |
| TTR-811 19 nt Target #3: | 5'-AGAGAAUCAAAAUUUUACA-3' | (SEQ ID NO: 3386) |
| TTR-812 19 nt Target #1: | 5'-GAAUCAAAAUUUUACAAAG-3' | (SEQ ID NO: 2619) |
| TTR-812 19 nt Target #2: | 5'-AGAAUCAAAAUUUUACAAA-3' | (SEQ ID NO: 3003) |
| TTR-812 19 nt Target #3: | 5'-GAGAAUCAAAAUUUUACAA-3' | (SEQ ID NO: 3387) |
| TTR-813 19 nt Target #1: | 5'-AAUCAAAAUUUUACAAAGA-3' | (SEQ ID NO: 2620) |
| TTR-813 19 nt Target #2: | 5'-GAAUCAAAAUUUUACAAAG-3' | (SEQ ID NO: 3004) |
| TTR-813 19 nt Target #3: | 5'-AGAAUCAAAAUUUUACAAA-3' | (SEQ ID NO: 3388) |
| TTR-814 19 nt Target #1: | 5'-AUCAAAAUUUUACAAAGAA-3' | (SEQ ID NO: 2621) |
| TTR-814 19 nt Target #2: | 5'-AAUCAAAAUUUUACAAAGA-3' | (SEQ ID NO: 3005) |
| TTR-814 19 nt Target #3: | 5'-GAAUCAAAAUUUUACAAAG-3' | (SEQ ID NO: 3389) |
| TTR-815 19 nt Target #1: | 5'-UCAAAAUUUUACAAAGAAU-3' | (SEQ ID NO: 2622) |
| TTR-815 19 nt Target #2: | 5'-AUCAAAAUUUUACAAAGAA-3' | (SEQ ID NO: 3006) |
| TTR-815 19 nt Target #3: | 5'-AAUCAAAAUUUUACAAAGA-3' | (SEQ ID NO: 3390) |
| TTR-816 19 nt Target #1: | 5'-CAAAAUUUUACAAAGAAUC-3' | (SEQ ID NO: 2623) |
| TTR-816 19 nt Target #2: | 5'-UCAAAAUUUUACAAAGAAU-3' | (SEQ ID NO: 3007) |
| TTR-816 19 nt Target #3: | 5'-AUCAAAAUUUUACAAAGAA-3' | (SEQ ID NO: 3391) |
| TTR-817 19 nt Target #1: | 5'-AAAAUUUUACAAAGAAUCA-3' | (SEQ ID NO: 2624) |
| TTR-817 19 nt Target #2: | 5'-CAAAAUUUUACAAAGAAUC-3' | (SEQ ID NO: 3008) |
| TTR-817 19 nt Target #3: | 5'-UCAAAAUUUUACAAAGAAU-3' | (SEQ ID NO: 3392) |
| TTR-818 19 nt Target #1: | 5'-AAAUUUUACAAAGAAUCAA-3' | (SEQ ID NO: 2625) |
| TTR-818 19 nt Target #2: | 5'-AAAAUUUUACAAAGAAUCA-3' | (SEQ ID NO: 3009) |
| TTR-818 19 nt Target #3: | 5'-CAAAAUUUUACAAAGAAUC-3' | (SEQ ID NO: 3393) |
| TTR-819 19 nt Target #1: | 5'-AAUUUUACAAAGAAUCAAA-3' | (SEQ ID NO: 2626) |
| TTR-819 19 nt Target #2: | 5'-AAAUUUUACAAAGAAUCAA-3' | (SEQ ID NO: 3010) |
| TTR-819 19 nt Target #3: | 5'-AAAAUUUUACAAAGAAUCA-3' | (SEQ ID NO: 3394) |
| TTR-821 19 nt Target #1: | 5'-UUUUACAAAGAAUCAAAGG-3' | (SEQ ID NO: 2627) |
| TTR-821 19 nt Target #2: | 5'-AUUUUACAAAGAAUCAAAG-3' | (SEQ ID NO: 3011) |
| TTR-821 19 nt Target #3: | 5'-AAUUUUACAAAGAAUCAAA-3' | (SEQ ID NO: 3395) |
| TTR-822 19 nt Target #1: | 5'-UUUACAAAGAAUCAAAGGA-3' | (SEQ ID NO: 2628) |
| TTR-822 19 nt Target #2: | 5'-UUUUACAAAGAAUCAAAGG-3' | (SEQ ID NO: 3012) |
| TTR-822 19 nt Target #3: | 5'-AUUUUACAAAGAAUCAAAG-3' | (SEQ ID NO: 3396) |

TABLE 6-continued

DsiRNA Component 19 Nucleotide Target Sequences in Transthyretin mRNA

| | |
|---|---|
| TTR-823 19 nt Target #1: 5'-UUACAAAGAAUCAAAGGAA-3' | (SEQ ID NO: 2629) |
| TTR-823 19 nt Target #2: 5'-UUUACAAAGAAUCAAAGGA-3' | (SEQ ID NO: 3013) |
| TTR-823 19 nt Target #3: 5'-UUUUACAAAGAAUCAAAGG-3' | (SEQ ID NO: 3397) |
| TTR-824 19 nt Target #1: 5'-UACAAAGAAUCAAAGGAAU-3' | (SEQ ID NO: 2630) |
| TTR-824 19 nt Target #2: 5'-UUACAAAGAAUCAAAGGAA-3' | (SEQ ID NO: 3014) |
| TTR-824 19 nt Target #3: 5'-UUUACAAAGAAUCAAAGGA-3' | (SEQ ID NO: 3398) |
| TTR-825 19 nt Target #1: 5'-ACAAAGAAUCAAAGGAAUU-3' | (SEQ ID NO: 2631) |
| TTR-825 19 nt Target #2: 5'-UACAAAGAAUCAAAGGAAU-3' | (SEQ ID NO: 3015) |
| TTR-825 19 nt Target #3: 5'-UUACAAAGAAUCAAAGGAA-3' | (SEQ ID NO: 3399) |
| TTR-826 19 nt Target #1: 5'-CAAAGAAUCAAAGGAAUUC-3' | (SEQ ID NO: 2632) |
| TTR-826 19 nt Target #2: 5'-ACAAAGAAUCAAAGGAAUU-3' | (SEQ ID NO: 3016) |
| TTR-826 19 nt Target #3: 5'-UACAAAGAAUCAAAGGAAU-3' | (SEQ ID NO: 3400) |
| TTR-827 19 nt Target #1: 5'-AAAGAAUCAAAGGAAUUCU-3' | (SEQ ID NO: 2633) |
| TTR-827 19 nt Target #2: 5'-CAAAGAAUCAAAGGAAUUC-3' | (SEQ ID NO: 3017) |
| TTR-827 19 nt Target #3: 5'-ACAAAGAAUCAAAGGAAUU-3' | (SEQ ID NO: 3401) |
| TTR-828 19 nt Target #1: 5'-AAGAAUCAAAGGAAUUCUA-3' | (SEQ ID NO: 2634) |
| TTR-828 19 nt Target #2: 5'-AAAGAAUCAAAGGAAUUCU-3' | (SEQ ID NO: 3018) |
| TTR-828 19 nt Target #3: 5'-CAAAGAAUCAAAGGAAUUC-3' | (SEQ ID NO: 3402) |
| TTR-829 19 nt Target #1: 5'-AGAAUCAAAGGAAUUCUAG-3' | (SEQ ID NO: 2635) |
| TTR-829 19 nt Target #2: 5'-AAGAAUCAAAGGAAUUCUA-3' | (SEQ ID NO: 3019) |
| TTR-829 19 nt Target #3: 5'-AAAGAAUCAAAGGAAUUCU-3' | (SEQ ID NO: 3403) |
| TTR-830 19 nt Target #1: 5'-GAAUCAAAGGAAUUCUAGA-3' | (SEQ ID NO: 2636) |
| TTR-830 19 nt Target #2: 5'-AGAAUCAAAGGAAUUCUAG-3' | (SEQ ID NO: 3020) |
| TTR-830 19 nt Target #3: 5'-AAGAAUCAAAGGAAUUCUA-3' | (SEQ ID NO: 3404) |
| TTR-831 19 nt Target #1: 5'-AAUCAAAGGAAUUCUAGAA-3' | (SEQ ID NO: 2637) |
| TTR-831 19 nt Target #2: 5'-GAAUCAAAGGAAUUCUAGA-3' | (SEQ ID NO: 3021) |
| TTR-831 19 nt Target #3: 5'-AGAAUCAAAGGAAUUCUAG-3' | (SEQ ID NO: 3405) |
| TTR-832 19 nt Target #1: 5'-AUCAAAGGAAUUCUAGAAA-3' | (SEQ ID NO: 2638) |
| TTR-832 19 nt Target #2: 5'-AAUCAAAGGAAUUCUAGAA-3' | (SEQ ID NO: 3022) |
| TTR-832 19 nt Target #3: 5'-GAAUCAAAGGAAUUCUAGA-3' | (SEQ ID NO: 3406) |
| TTR-833 19 nt Target #1: 5'-UCAAAGGAAUUCUAGAAAG-3' | (SEQ ID NO: 2639) |
| TTR-833 19 nt Target #2: 5'-AUCAAAGGAAUUCUAGAAA-3' | (SEQ ID NO: 3023) |
| TTR-833 19 nt Target #3: 5'-AAUCAAAGGAAUUCUAGAA-3' | (SEQ ID NO: 3407) |
| TTR-834 19 nt Target #1: 5'-CAAAGGAAUUCUAGAAAGU-3' | (SEQ ID NO: 2640) |
| TTR-834 19 nt Target #2: 5'-UCAAAGGAAUUCUAGAAAG-3' | (SEQ ID NO: 3024) |
| TTR-834 19 nt Target #3: 5'-AUCAAAGGAAUUCUAGAAA-3' | (SEQ ID NO: 3408) |
| TTR-835 19 nt Target #1: 5'-AAAGGAAUUCUAGAAAGUA-3' | (SEQ ID NO: 2641) |
| TTR-835 19 nt Target #2: 5'-CAAAGGAAUUCUAGAAAGU-3' | (SEQ ID NO: 3025) |

TABLE 6-continued

DsiRNA Component 19 Nucleotide Target Sequences in Transthyretin mRNA

| | | |
|---|---|---|
| TTR-835 19 nt Target #3: | 5'-UCAAAGGAAUUCUAGAAAG-3' | (SEQ ID NO: 3409) |
| TTR-869 19 nt Target #1: | 5'-AGGAGAGAUCCAAAUUUCC-3' | (SEQ ID NO: 2642) |
| TTR-869 19 nt Target #2: | 5'-UAGGAGAGAUCCAAAUUUC-3' | (SEQ ID NO: 3026) |
| TTR-869 19 nt Target #3: | 5'-CUAGGAGAGAUCCAAAUUU-3' | (SEQ ID NO: 3410) |
| TTR-870 19 nt Target #1: | 5'-GGAGAGAUCCAAAUUUCCA-3' | (SEQ ID NO: 2643) |
| TTR-870 19 nt Target #2: | 5'-AGGAGAGAUCCAAAUUUCC-3' | (SEQ ID NO: 3027) |
| TTR-870 19 nt Target #3: | 5'-UAGGAGAGAUCCAAAUUUC-3' | (SEQ ID NO: 3411) |
| TTR-873 19 nt Target #1: | 5'-GAGAUCCAAAUUUCCAUUG-3' | (SEQ ID NO: 2644) |
| TTR-873 19 nt Target #2: | 5'-AGAGAUCCAAAUUUCCAUU-3' | (SEQ ID NO: 3028) |
| TTR-873 19 nt Target #3: | 5'-GAGAGAUCCAAAUUUCCAU-3' | (SEQ ID NO: 3412) |
| TTR-874 19 nt Target #1: | 5'-AGAUCCAAAUUUCCAUUGU-3' | (SEQ ID NO: 2645) |
| TTR-874 19 nt Target #2: | 5'-GAGAUCCAAAUUUCCAUUG-3' | (SEQ ID NO: 3029) |
| TTR-874 19 nt Target #3: | 5'-AGAGAUCCAAAUUUCCAUU-3' | (SEQ ID NO: 3413) |
| TTR-875 19 nt Target #1: | 5'-GAUCCAAAUUUCCAUUGUC-3' | (SEQ ID NO: 2646) |
| TTR-875 19 nt Target #2: | 5'-AGAUCCAAAUUUCCAUUGU-3' | (SEQ ID NO: 3030) |
| TTR-875 19 nt Target #3: | 5'-GAGAUCCAAAUUUCCAUUG-3' | (SEQ ID NO: 3414) |
| TTR-876 19 nt Target #1: | 5'-AUCCAAAUUUCCAUUGUCU-3' | (SEQ ID NO: 2647) |
| TTR-876 19 nt Target #2: | 5'-GAUCCAAAUUUCCAUUGUC-3' | (SEQ ID NO: 3031) |
| TTR-876 19 nt Target #3: | 5'-AGAUCCAAAUUUCCAUUGU-3' | (SEQ ID NO: 3415) |
| TTR-877 19 nt Target #1: | 5'-UCCAAAUUUCCAUUGUCUU-3' | (SEQ ID NO: 2648) |
| TTR-877 19 nt Target #2: | 5'-AUCCAAAUUUCCAUUGUCU-3' | (SEQ ID NO: 3032) |
| TTR-877 19 nt Target #3: | 5'-GAUCCAAAUUUCCAUUGUC-3' | (SEQ ID NO: 3416) |
| TTR-878 19 nt Target #1: | 5'-CCAAAUUUCCAUUGUCUUG-3' | (SEQ ID NO: 2649) |
| TTR-878 19 nt Target #2: | 5'-UCCAAAUUUCCAUUGUCUU-3' | (SEQ ID NO: 3033) |
| TTR-878 19 nt Target #3: | 5'-AUCCAAAUUUCCAUUGUCU-3' | (SEQ ID NO: 3417) |
| TTR-879 19 nt Target #1: | 5'-CAAAUUUCCAUUGUCUUGC-3' | (SEQ ID NO: 2650) |
| TTR-879 19 nt Target #2: | 5'-CCAAAUUUCCAUUGUCUUG-3' | (SEQ ID NO: 3034) |
| TTR-879 19 nt Target #3: | 5'-UCCAAAUUUCCAUUGUCUU-3' | (SEQ ID NO: 3418) |
| TTR-880 19 nt Target #1: | 5'-AAAUUUCCAUUGUCUUGCA-3' | (SEQ ID NO: 2651) |
| TTR-880 19 nt Target #2: | 5'-CAAAUUUCCAUUGUCUUGC-3' | (SEQ ID NO: 3035) |
| TTR-880 19 nt Target #3: | 5'-CCAAAUUUCCAUUGUCUUG-3' | (SEQ ID NO: 3419) |
| TTR-881 19 nt Target #1: | 5'-AAUUUCCAUUGUCUUGCAA-3' | (SEQ ID NO: 2652) |
| TTR-881 19 nt Target #2: | 5'-AAAUUUCCAUUGUCUUGCA-3' | (SEQ ID NO: 3036) |
| TTR-881 19 nt Target #3: | 5'-CAAAUUUCCAUUGUCUUGC-3' | (SEQ ID NO: 3420) |
| TTR-882 19 nt Target #1: | 5'-AUUUCCAUUGUCUUGCAAG-3' | (SEQ ID NO: 2653) |
| TTR-882 19 nt Target #2: | 5'-AAUUUCCAUUGUCUUGCAA-3' | (SEQ ID NO: 3037) |
| TTR-882 19 nt Target #3: | 5'-AAAUUUCCAUUGUCUUGCA-3' | (SEQ ID NO: 3421) |
| TTR-883 19 nt Target #1: | 5'-UUUCCAUUGUCUUGCAAGC-3' | (SEQ ID NO: 2654) |
| TTR-883 19 nt Target #2: | 5'-AUUUCCAUUGUCUUGCAAG-3' | (SEQ ID NO: 3038) |

TABLE 6-continued

DsiRNA Component 19 Nucleotide Target Sequences in Transthyretin mRNA

| | | |
|---|---|---|
| TTR-883 19 nt Target #3: | 5'-AAUUUCCAUUGUCUUGCAA-3' | (SEQ ID NO: 3422) |
| TTR-884 19 nt Target #1: | 5'-UUCCAUUGUCUUGCAAGCA-3' | (SEQ ID NO: 2655) |
| TTR-884 19 nt Target #2: | 5'-UUUCCAUUGUCUUGCAAGC-3' | (SEQ ID NO: 3039) |
| TTR-884 19 nt Target #3: | 5'-AUUUCCAUUGUCUUGCAAG-3' | (SEQ ID NO: 3423) |
| TTR-885 19 nt Target #1: | 5'-UCCAUUGUCUUGCAAGCAA-3' | (SEQ ID NO: 2656) |
| TTR-885 19 nt Target #2: | 5'-UUCCAUUGUCUUGCAAGCA-3' | (SEQ ID NO: 3040) |
| TTR-885 19 nt Target #3: | 5'-UUUCCAUUGUCUUGCAAGC-3' | (SEQ ID NO: 3424) |
| TTR-886 19 nt Target #1: | 5'-CCAUUGUCUUGCAAGCAAA-3' | (SEQ ID NO: 2657) |
| TTR-886 19 nt Target #2: | 5'-UCCAUUGUCUUGCAAGCAA-3' | (SEQ ID NO: 3041) |
| TTR-886 19 nt Target #3: | 5'-UUCCAUUGUCUUGCAAGCA-3' | (SEQ ID NO: 3425) |
| TTR-887 19 nt Target #1: | 5'-CAUUGUCUUGCAAGCAAAG-3' | (SEQ ID NO: 2658) |
| TTR-887 19 nt Target #2: | 5'-CCAUUGUCUUGCAAGCAAA-3' | (SEQ ID NO: 3042) |
| TTR-887 19 nt Target #3: | 5'-UCCAUUGUCUUGCAAGCAA-3' | (SEQ ID NO: 3426) |
| TTR-888 19 nt Target #1: | 5'-AUUGUCUUGCAAGCAAAGC-3' | (SEQ ID NO: 2659) |
| TTR-888 19 nt Target #2: | 5'-CAUUGUCUUGCAAGCAAAG-3' | (SEQ ID NO: 3043) |
| TTR-888 19 nt Target #3: | 5'-CCAUUGUCUUGCAAGCAAA-3' | (SEQ ID NO: 3427) |
| TTR-889 19 nt Target #1: | 5'-UUGUCUUGCAAGCAAAGCA-3' | (SEQ ID NO: 2660) |
| TTR-889 19 nt Target #2: | 5'-AUUGUCUUGCAAGCAAAGC-3' | (SEQ ID NO: 3044) |
| TTR-889 19 nt Target #3: | 5'-CAUUGUCUUGCAAGCAAAG-3' | (SEQ ID NO: 3428) |
| TTR-890 19 nt Target #1: | 5'-UGUCUUGCAAGCAAAGCAC-3' | (SEQ ID NO: 2661) |
| TTR-890 19 nt Target #2: | 5'-UUGUCUUGCAAGCAAAGCA-3' | (SEQ ID NO: 3045) |
| TTR-890 19 nt Target #3: | 5'-AUUGUCUUGCAAGCAAAGC-3' | (SEQ ID NO: 3429) |
| TTR-891 19 nt Target #1: | 5'-GUCUUGCAAGCAAAGCACG-3' | (SEQ ID NO: 2662) |
| TTR-891 19 nt Target #2: | 5'-UGUCUUGCAAGCAAAGCAC-3' | (SEQ ID NO: 3046) |
| TTR-891 19 nt Target #3: | 5'-UUGUCUUGCAAGCAAAGCA-3' | (SEQ ID NO: 3430) |
| TTR-892 19 nt Target #1: | 5'-UCUUGCAAGCAAAGCACGU-3' | (SEQ ID NO: 2663) |
| TTR-892 19 nt Target #2: | 5'-GUCUUGCAAGCAAAGCACG-3' | (SEQ ID NO: 3047) |
| TTR-892 19 nt Target #3: | 5'-UGUCUUGCAAGCAAAGCAC-3' | (SEQ ID NO: 3431) |
| TTR-893 19 nt Target #1: | 5'-CUUGCAAGCAAAGCACGUA-3' | (SEQ ID NO: 2664) |
| TTR-893 19 nt Target #2: | 5'-UCUUGCAAGCAAAGCACGU-3' | (SEQ ID NO: 3048) |
| TTR-893 19 nt Target #3: | 5'-GUCUUGCAAGCAAAGCACG-3' | (SEQ ID NO: 3432) |
| TTR-894 19 nt Target #1: | 5'-UUGCAAGCAAAGCACGUAU-3' | (SEQ ID NO: 2665) |
| TTR-894 19 nt Target #2: | 5'-CUUGCAAGCAAAGCACGUA-3' | (SEQ ID NO: 3049) |
| TTR-894 19 nt Target #3: | 5'-UCUUGCAAGCAAAGCACGU-3' | (SEQ ID NO: 3433) |
| TTR-895 19 nt Target #1: | 5'-UGCAAGCAAAGCACGUAUU-3' | (SEQ ID NO: 2666) |
| TTR-895 19 nt Target #2: | 5'-UUGCAAGCAAAGCACGUAU-3' | (SEQ ID NO: 3050) |
| TTR-895 19 nt Target #3: | 5'-CUUGCAAGCAAAGCACGUA-3' | (SEQ ID NO: 3434) |
| TTR-896 19 nt Target #1: | 5'-GCAAGCAAAGCACGUAUUA-3' | (SEQ ID NO: 2667) |

TABLE 6-continued

DsiRNA Component 19 Nucleotide Target Sequences in Transthyretin mRNA

| | |
|---|---|
| TTR-896 19 nt Target #2: 5'-UGCAAGCAAAGCACGUAUU-3' | (SEQ ID NO: 3051) |
| TTR-896 19 nt Target #3: 5'-UUGCAAGCAAAGCACGUAU-3' | (SEQ ID NO: 3435) |
| TTR-897 19 nt Target #1: 5'-CAAGCAAAGCACGUAUUAA-3' | (SEQ ID NO: 2668) |
| TTR-897 19 nt Target #2: 5'-GCAAGCAAAGCACGUAUUA-3' | (SEQ ID NO: 3052) |
| TTR-897 19 nt Target #3: 5'-UGCAAGCAAAGCACGUAUU-3' | (SEQ ID NO: 3436) |
| TTR-898 19 nt Target #1: 5'-AAGCAAAGCACGUAUUAAA-3' | (SEQ ID NO: 2669) |
| TTR-898 19 nt Target #2: 5'-CAAGCAAAGCACGUAUUAA-3' | (SEQ ID NO: 3053) |
| TTR-898 19 nt Target #3: 5'-GCAAGCAAAGCACGUAUUA-3' | (SEQ ID NO: 3437) |
| TTR-899 19 nt Target #1: 5'-AGCAAAGCACGUAUUAAAU-3' | (SEQ ID NO: 2670) |
| TTR-899 19 nt Target #2: 5'-AAGCAAAGCACGUAUUAAA-3' | (SEQ ID NO: 3054) |
| TTR-899 19 nt Target #3: 5'-CAAGCAAAGCACGUAUUAA-3' | (SEQ ID NO: 3438) |
| TTR-900 19 nt Target #1: 5'-GCAAAGCACGUAUUAAAUA-3' | (SEQ ID NO: 2671) |
| TTR-900 19 nt Target #2: 5'-AGCAAAGCACGUAUUAAAU-3' | (SEQ ID NO: 3055) |
| TTR-900 19 nt Target #3: 5'-AAGCAAAGCACGUAUUAAA-3' | (SEQ ID NO: 3439) |
| TTR-901 19 nt Target #1: 5'-CAAAGCACGUAUUAAAUAU-3' | (SEQ ID NO: 2672) |
| TTR-901 19 nt Target #2: 5'-GCAAAGCACGUAUUAAAUA-3' | (SEQ ID NO: 3056) |
| TTR-901 19 nt Target #3: 5'-AGCAAAGCACGUAUUAAAU-3' | (SEQ ID NO: 3440) |
| TTR-902 19 nt Target #1: 5'-AAAGCACGUAUUAAAUAUG-3' | (SEQ ID NO: 2673) |
| TTR-902 19 nt Target #2: 5'-CAAAGCACGUAUUAAAUAU-3' | (SEQ ID NO: 3057) |
| TTR-902 19 nt Target #3: 5'-GCAAAGCACGUAUUAAAUA-3' | (SEQ ID NO: 3441) |
| TTR-903 19 nt Target #1: 5'-AAGCACGUAUUAAAUAUGA-3' | (SEQ ID NO: 2674) |
| TTR-903 19 nt Target #2: 5'-AAAGCACGUAUUAAAUAUG-3' | (SEQ ID NO: 3058) |
| TTR-903 19 nt Target #3: 5'-CAAAGCACGUAUUAAAUAU-3' | (SEQ ID NO: 3442) |
| TTR-904 19 nt Target #1: 5'-AGCACGUAUUAAAUAUGAU-3' | (SEQ ID NO: 2675) |
| TTR-904 19 nt Target #2: 5'-AAGCACGUAUUAAAUAUGA-3' | (SEQ ID NO: 3059) |
| TTR-904 19 nt Target #3: 5'-AAAGCACGUAUUAAAUAUG-3' | (SEQ ID NO: 3443) |
| TTR-905 19 nt Target #1: 5'-GCACGUAUUAAAUAUGAUC-3' | (SEQ ID NO: 2676) |
| TTR-905 19 nt Target #2: 5'-AGCACGUAUUAAAUAUGAU-3' | (SEQ ID NO: 3060) |
| TTR-905 19 nt Target #3: 5'-AAGCACGUAUUAAAUAUGA-3' | (SEQ ID NO: 3444) |
| TTR-906 19 nt Target #1: 5'-CACGUAUUAAAUAUGAUCU-3' | (SEQ ID NO: 2677) |
| TTR-906 19 nt Target #2: 5'-GCACGUAUUAAAUAUGAUC-3' | (SEQ ID NO: 3061) |
| TTR-906 19 nt Target #3: 5'-AGCACGUAUUAAAUAUGAU-3' | (SEQ ID NO: 3445) |
| TTR-908 19 nt Target #1: 5'-CGUAUUAAAUAUGAUCUGC-3' | (SEQ ID NO: 2678) |
| TTR-908 19 nt Target #2: 5'-ACGUAUUAAAUAUGAUCUG-3' | (SEQ ID NO: 3062) |
| TTR-908 19 nt Target #3: 5'-CACGUAUUAAAUAUGAUCU-3' | (SEQ ID NO: 3446) |
| TTR-909 19 nt Target #1: 5'-GUAUUAAAUAUGAUCUGCA-3' | (SEQ ID NO: 2679) |
| TTR-909 19 nt Target #2: 5'-CGUAUUAAAUAUGAUCUGC-3' | (SEQ ID NO: 3063) |
| TTR-909 19 nt Target #3: 5'-ACGUAUUAAAUAUGAUCUG-3' | (SEQ ID NO: 3447) |
| TTR-911 19 nt Target #1: 5'-AUUAAAUAUGAUCUGCAGC-3' | (SEQ ID NO: 2680) |

TABLE 6-continued

DsiRNA Component 19 Nucleotide Target Sequences in Transthyretin mRNA

| | | |
|---|---|---|
| TTR-911 19 nt Target #2: | 5'-UAUUAAAUAUGAUCUGCAG-3' | (SEQ ID NO: 3064) |
| TTR-911 19 nt Target #3: | 5'-GUAUUAAAUAUGAUCUGCA-3' | (SEQ ID NO: 3448) |
| TTR-912 19 nt Target #1: | 5'-UUAAAUAUGAUCUGCAGCC-3' | (SEQ ID NO: 2681) |
| TTR-912 19 nt Target #2: | 5'-AUUAAAUAUGAUCUGCAGC-3' | (SEQ ID NO: 3065) |
| TTR-912 19 nt Target #3: | 5'-UAUUAAAUAUGAUCUGCAG-3' | (SEQ ID NO: 3449) |
| TTR-913 19 nt Target #1: | 5'-UAAAUAUGAUCUGCAGCCA-3' | (SEQ ID NO: 2682) |
| TTR-913 19 nt Target #2: | 5'-UUAAAUAUGAUCUGCAGCC-3' | (SEQ ID NO: 3066) |
| TTR-913 19 nt Target #3: | 5'-AUUAAAUAUGAUCUGCAGC-3' | (SEQ ID NO: 3450) |
| TTR-914 19 nt Target #1: | 5'-AAAUAUGAUCUGCAGCCAU-3' | (SEQ ID NO: 2683) |
| TTR-914 19 nt Target #2: | 5'-UAAAUAUGAUCUGCAGCCA-3' | (SEQ ID NO: 3067) |
| TTR-914 19 nt Target #3: | 5'-UUAAAUAUGAUCUGCAGCC-3' | (SEQ ID NO: 3451) |
| TTR-915 19 nt Target #1: | 5'-AAUAUGAUCUGCAGCCAUU-3' | (SEQ ID NO: 2684) |
| TTR-915 19 nt Target #2: | 5'-AAAUAUGAUCUGCAGCCAU-3' | (SEQ ID NO: 3068) |
| TTR-915 19 nt Target #3: | 5'-UAAAUAUGAUCUGCAGCCA-3' | (SEQ ID NO: 3452) |
| TTR-916 19 nt Target #1: | 5'-AUAUGAUCUGCAGCCAUUA-3' | (SEQ ID NO: 2685) |
| TTR-916 19 nt Target #2: | 5'-AAUAUGAUCUGCAGCCAUU-3' | (SEQ ID NO: 3069) |
| TTR-916 19 nt Target #3: | 5'-AAAUAUGAUCUGCAGCCAU-3' | (SEQ ID NO: 3453) |
| TTR-917 19 nt Target #1: | 5'-UAUGAUCUGCAGCCAUUAA-3' | (SEQ ID NO: 2686) |
| TTR-917 19 nt Target #2: | 5'-AUAUGAUCUGCAGCCAUUA-3' | (SEQ ID NO: 3070) |
| TTR-917 19 nt Target #3: | 5'-AAUAUGAUCUGCAGCCAUU-3' | (SEQ ID NO: 3454) |
| TTR-918 19 nt Target #1: | 5'-AUGAUCUGCAGCCAUUAAA-3' | (SEQ ID NO: 2687) |
| TTR-918 19 nt Target #2: | 5'-UAUGAUCUGCAGCCAUUAA-3' | (SEQ ID NO: 3071) |
| TTR-918 19 nt Target #3: | 5'-AUAUGAUCUGCAGCCAUUA-3' | (SEQ ID NO: 3455) |
| TTR-919 19 nt Target #1: | 5'-UGAUCUGCAGCCAUUAAAA-3' | (SEQ ID NO: 2688) |
| TTR-919 19 nt Target #2: | 5'-AUGAUCUGCAGCCAUUAAA-3' | (SEQ ID NO: 3072) |
| TTR-919 19 nt Target #3: | 5'-UAUGAUCUGCAGCCAUUAA-3' | (SEQ ID NO: 3456) |

Within Tables 2, 3 and 5 above, underlined residues indicate 2'-O-methyl residues, UPPER CASE indicates ribonucleotides, and lower case denotes deoxyribonucleotides. The DsiRNA agents of Tables 2 and 3 above are 25/27 mer agents possessing a blunt end. The structures and/or modification patterning of the agents of Tables 2 and 3 above can be readily adapted to the above generic sequence structures, e.g., the 3' overhang of the second strand can be extended or contracted, 2'-O-methylation of the second strand can be expanded towards the 5' end of the second strand, optionally at alternating sites, etc. Such further modifications are optional, as 25/27 mer DsiRNAs with such modifications can also be readily designed from the above DsiRNA agents and are also expected to be functional inhibitors of transthyretin expression. Similarly, the 27 mer "blunt/blunt" DsiRNA structures and/or modification patterns of the agents of Table 5 above can also be readily adapted to the above generic sequence structures, e.g., for application of modification patterning of the antisense strand to such structures and/or adaptation of such sequences to the above generic structures.

In certain embodiments, 27 mer DsiRNAs possessing independent strand lengths each of 27 nucleotides are designed and synthesized for targeting of the same sites within the transthyretin transcript as the asymmetric "25/27" structures shown in Tables 2 and 3 herein. Exemplary "27/27" DsiRNAs are optionally designed with a "blunt/blunt" structure as shown for the DsiRNAs of Table 5 above.

In certain embodiments, the dsRNA agents of the invention require, e.g., at least 19, at least 20, at least 21, at least 22, at least 23, at least 24, at least 25 or at least 26 residues of the first strand to be complementary to corresponding residues of the second strand. In certain related embodiments, these first strand residues complementary to corresponding residues of the second strand are optionally consecutive residues.

As used herein "DsiRNAmm" refers to a DisRNA having a "mismatch tolerant region" containing one, two, three or four mismatched base pairs of the duplex formed by the sense and antisense strands of the DsiRNA, where such mismatches are positioned within the DsiRNA at a location(s) lying between (and thus not including) the two terminal base pairs of either end of the DsiRNA. The mismatched base pairs are located within a "mismatch-tolerant region" which is defined herein with respect to the location of the projected Ago2 cut site of the corresponding target nucleic acid. The mismatch tolerant region is located "upstream of" the projected Ago2 cut site of the target strand. "Upstream" in this context will be understood as the 5'-most portion of the DsiRNAmm duplex, where 5' refers to the orientation of the sense strand of the DsiRNA duplex. Therefore, the mismatch tolerant region is upstream of the base on the sense (passenger) strand that corresponds to the projected Ago2 cut site of the target nucleic acid (see FIG. 1); alternatively, when referring to the antisense (guide) strand of the DsiRNAmm, the mismatch tolerant region can also be described as positioned downstream of the base that is complementary to the projected Ago2 cut site of the target nucleic acid, that is, the 3'-most portion of the antisense strand of the DsiRNAmm (where position 1 of the antisense strand is the 5' terminal nucleotide of the antisense strand, see FIG. 1).

In one embodiment, for example with numbering as depicted in FIG. 1, the mismatch tolerant region is positioned between and including base pairs 3-9 when numbered from the nucleotide starting at the 5' end of the sense strand of the duplex. Therefore, a DsiRNAmm of the invention possesses a single mismatched base pair at any one of positions 3, 4, 5, 6, 7, 8 or 9 of the sense strand of a right-hand extended DsiRNA (where position 1 is the 5' terminal nucleotide of the sense strand and position 9 is the nucleotide residue of the sense strand that is immediately 5' of the projected Ago2 cut site of the target transthyretin RNA sequence corresponding to the sense strand sequence). In certain embodiments, for a DsiRNAmm that possesses a mismatched base pair nucleotide at any of positions 3, 4, 5, 6, 7, 8 or 9 of the sense strand, the corresponding mismatched base pair nucleotide of the antisense strand not only forms a mismatched base pair with the DsiRNAmm sense strand sequence, but also forms a mismatched base pair with a DsiRNAmm target transthyretin RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target transthyretin RNA sequence). In alternative embodiments, the mismatch base pair nucleotide of the antisense strand of a DsiRNAmm only form a mismatched base pair with a corresponding nucleotide of the sense strand sequence of the DsiRNAmm, yet base pairs with its corresponding target transthyretin RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target transthyretin RNA sequence).

A DsiRNAmm of the invention that possesses a single mismatched base pair within the mismatch-tolerant region (mismatch region) as described above (e.g., a DsiRNAmm harboring a mismatched nucleotide residue at any one of positions 3, 4, 5, 6, 7, 8 or 9 of the sense strand) can further include one, two or even three additional mismatched base pairs. In preferred embodiments, these one, two or three additional mismatched base pairs of the DsiRNAmm occur at position(s) 3, 4, 5, 6, 7, 8 and/or 9 of the sense strand (and at corresponding residues of the antisense strand). In one embodiment where one additional mismatched base pair is present within a DsiRNAmm, the two mismatched base pairs of the sense strand can occur, e.g., at nucleotides of both position 4 and position 6 of the sense strand (with mismatch also occurring at corresponding nucleotide residues of the antisense strand).

In DsiRNAmm agents possessing two mismatched base pairs, mismatches can occur consecutively (e.g., at consecutive positions along the sense strand nucleotide sequence). Alternatively, nucleotides of the sense strand that form mismatched base pairs with the antisense strand sequence can be interspersed by nucleotides that base pair with the antisense strand sequence (e.g., for a DsiRNAmm possessing mismatched nucleotides at positions 3 and 6, but not at positions 4 and 5, the mismatched residues of sense strand positions 3 and 6 are interspersed by two nucleotides that form matched base pairs with corresponding residues of the antisense strand). For example, two residues of the sense strand (located within the mismatch-tolerant region of the sense strand) that form mismatched base pairs with the corresponding antisense strand sequence can occur with zero, one, two, three, four or five matched base pairs located between these mismatched base pairs.

For certain DsiRNAmm agents possessing three mismatched base pairs, mismatches can occur consecutively (e.g., in a triplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 4 and 8, but not at positions 5, 6 and 7, the mismatched residues of sense strand positions 3 and 4 are adjacent to one another, while the mismatched residues of sense strand positions 4 and 8 are interspersed by three nucleotides that form matched base pairs with corresponding residues of the antisense strand). For example, three residues of the sense strand (located within the mismatch-tolerant region of the sense strand) that form mismatched base pairs with the corresponding antisense strand sequence can occur with zero, one, two, three or four matched base pairs located between any two of these mismatched base pairs.

For certain DsiRNAmm agents possessing four mismatched base pairs, mismatches can occur consecutively (e.g., in a quadruplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 5, 7 and 8, but not at positions 4 and 6, the mismatched residues of sense strand positions 7 and 8 are adjacent to one another, while the mismatched residues of sense strand positions 3 and 5 are interspersed by one nucleotide that forms a matched base pair with the corresponding residue of the antisense strand—similarly, the the mismatched residues of sense strand positions 5 and 7 are also interspersed by one nucleotide that forms a matched base pair with the corresponding residue of the antisense strand). For example, four residues of the sense strand (located within the mismatch-tolerant region of the sense strand) that form mismatched base pairs with the corresponding antisense strand sequence can occur with zero, one, two or three matched base pairs located between any two of these mismatched base pairs.

In another embodiment, for example with numbering also as depicted in FIG. 1, a DsiRNAmm of the invention comprises a mismatch tolerant region which possesses a single mismatched base pair nucleotide at any one of positions 17, 18, 19, 20, 21, 22 or 23 of the antisense strand of the DsiRNA (where position 1 is the 5' terminal nucleotide of the antisense strand and position 17 is the nucleotide residue of the antisense strand that is immediately 3' (downstream) in the antisense strand of the projected Ago2 cut site of the target transthyretin RNA sequence sufficiently complementary to the antisense strand sequence). In certain embodiments, for a DsiRNAmm that possesses a mismatched base pair nucleotide at any of positions 17, 18, 19, 20, 21, 22 or 23 of the antisense strand with respect to the sense strand of the DsiRNAmm, the mismatched base pair nucleotide of the antisense strand not only forms a mismatched base pair with the DsiRNAmm sense strand sequence, but also forms a mismatched base pair with a DsiRNAmm target transthyretin RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target transthyretin RNA sequence). In alternative embodiments, the mismatch base pair nucleotide of the antisense strand of a DsiRNAmm only forms a mismatched base pair with a corresponding nucleotide of the sense strand sequence of the DsiRNAmm, yet base pairs with its corresponding target transthyretin RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target transthyretin RNA sequence).

A DsiRNAmm of the invention that possesses a single mismatched base pair within the mismatch-tolerant region as described above (e.g., a DsiRNAmm harboring a mismatched nucleotide residue at positions 17, 18, 19, 20, 21, 22 or 23 of the antisense strand) can further include one, two or even three additional mismatched base pairs. In preferred embodiments, these one, two or three additional mismatched base pairs of the DsiRNAmm occur at position(s) 17, 18, 19, 20, 21, 22 and/or 23 of the antisense strand (and at corresponding residues of the sense strand). In one embodiment where one additional mismatched base pair is present within a DsiRNAmm, the two mismatched base pairs of the antisense strand can occur, e.g., at nucleotides of both position 18 and position 20 of the antisense strand (with mismatch also occurring at corresponding nucleotide residues of the sense strand).

In DsiRNAmm agents possessing two mismatched base pairs, mismatches can occur consecutively (e.g., at consecutive positions along the antisense strand nucleotide sequence). Alternatively, nucleotides of the antisense strand that form mismatched base pairs with the sense strand sequence can be interspersed by nucleotides that base pair with the sense strand sequence (e.g., for a DsiRNAmm possessing mismatched nucleotides at positions 17 and 20, but not at positions 18 and 19, the mismatched residues of antisense strand positions 17 and 20 are interspersed by two nucleotides that form matched base pairs with corresponding residues of the sense strand). For example, two residues of the antisense strand (located within the mismatch-tolerant region of the sense strand) that form mismatched base pairs with the corresponding sense strand sequence can occur with zero, one, two, three, four, five, six or seven matched base pairs located between these mismatched base pairs.

For certain DsiRNAmm agents possessing three mismatched base pairs, mismatches can occur consecutively (e.g., in a triplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 17, 18 and 22, but not at positions 19, 20 and 21, the mismatched residues of antisense strand positions 17 and 18 are adjacent to one another, while the mismatched residues of antisense strand positions 18 and 122 are interspersed by three nucleotides that form matched base pairs with corresponding residues of the sense strand). For example, three residues of the antisense strand (located within the mismatch-tolerant region of the antisense strand) that form mismatched base pairs with the corresponding sense strand sequence can occur with zero, one, two, three, four, five or six matched base pairs located between any two of these mismatched base pairs.

For certain DsiRNAmm agents possessing four mismatched base pairs, mismatches can occur consecutively (e.g., in a quadruplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 18, 20, 22 and 23, but not at positions 19 and 21, the mismatched residues of antisense strand positions 22 and 23 are adjacent to one another, while the mismatched residues of antisense strand positions 18 and 20 are interspersed by one nucleotide that forms a matched base pair with the corresponding residue of the sense strand—similarly, the the mismatched residues of antisense strand positions 20 and 22 are also interspersed by one nucleotide that forms a matched base pair with the corresponding residue of the sense strand). For example, four residues of the antisense strand (located within the mismatch-tolerant region of the antisense strand) that form mismatched base pairs with the corresponding sense strand sequence can occur with zero, one, two, three, four or five matched base pairs located between any two of these mismatched base pairs.

For reasons of clarity, the location(s) of mismatched nucleotide residues within the above DsiRNAmm agents are numbered in reference to the 5' terminal residue of either sense or antisense strands of the DsiRNAmm. The numbering of positions located within the mismatch-tolerant region (mismatch region) of the antisense strand can shift with variations in the proximity of the 5' terminus of the sense or antisense strand to the projected Ago2 cleavage site. Thus, the location(s) of preferred mismatch sites within either antisense strand or sense strand can also be identified as the permissible proximity of such mismatches to the projected Ago2 cut site. Accordingly, in one preferred embodiment, the position of a mismatch nucleotide of the sense strand of a DsiRNAmm is the nucleotide residue of the sense strand that is located immediately 5' (upstream) of the projected Ago2 cleavage site of the corresponding target transthyretin RNA sequence. In other preferred embodiments, a mismatch nucleotide of the sense strand of a DsiRNAmm is positioned at the nucleotide residue of the sense strand that is located two nucleotides 5' (upstream) of the projected Ago2 cleavage site, three nucleotides 5' (upstream) of the projected Ago2 cleavage site, four nucleotides 5' (upstream) of the projected Ago2 cleavage site, five nucleotides 5' (upstream) of the projected Ago2 cleavage site, six nucleotides 5' (upstream) of the projected Ago2 cleavage site, seven nucleotides 5' (upstream) of the projected Ago2 cleavage site, eight nucleotides 5' (upstream) of the projected Ago2 cleavage site, or nine nucleotides 5' (upstream) of the projected Ago2 cleavage site.

Exemplary single mismatch-containing 25/27 mer DsiRNAs (DsiRNAmm) include the following structures (such mismatch-containing structures may also be incorporated into other exemplary DsiRNA structures shown herein).

```
5'-XX M XXXXXXXXXXXXXXXXXXXXXDD-3'
3'-XXXX M XXXXXXXXXXXXXXXXXXXXX-5'
5'-XXX M XXXXXXXXXXXXXXXXXXXXXDD-3'
3'-XXXXX M XXXXXXXXXXXXXXXXXXXX-5'
5'-XXXX M XXXXXXXXXXXXXXXXXXXXDD-3'
3'-XXXXXX M XXXXXXXXXXXXXXXXXXX-5'
5'-XXXXX M XXXXXXXXXXXXXXXXXXXDD-3'
3'-XXXXXXX M XXXXXXXXXXXXXXXXXX-5'
5'-XXXXXX M XXXXXXXXXXXXXXXXXXDD-3'
3'-XXXXXXXX M XXXXXXXXXXXXXXXXX-5'
5'-XXXXXXX M XXXXXXXXXXXXXXXXXDD-3'
3'-XXXXXXXXX M XXXXXXXXXXXXXXXX-5'
5'-XXXXXXXX M XXXXXXXXXXXXXXXXDD-3'
3'-XXXXXXXXXX M XXXXXXXXXXXXXXX-5'
``` wherein "X"=RNA, "D"=DNA and "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNAmm agents. For the above mismatch structures, the top strand is the sense strand, and the bottom strand is the antisense strand.

In certain embodiments, a DsiRNA of the invention can contain mismatches that exist in reference to the target transthyretin RNA sequence yet do not necessarily exist as mismatched base pairs within the two strands of the DsiRNA—thus, a DsiRNA can possess perfect complementarity between first and second strands of a DsiRNA, yet still possess mismatched residues in reference to a target transthyretin RNA (which, in certain embodiments, may be advantageous in promoting efficacy and/or potency and/or duration of effect). In certain embodiments, where mismatches occur between antisense strand and target transthyretin RNA sequence, the position of a mismatch is located within the antisense strand at a position(s) that corresponds to a sequence of the sense strand located 5' of the projected Ago2 cut site of the target region—e.g., antisense strand residue(s) positioned within the antisense strand to the 3' of the antisense residue which is complementary to the projected Ago2 cut site of the target sequence.

Exemplary 25/27 mer DsiRNAs that harbor a single mismatched residue in reference to target sequences include the following structures.

```
Target RNA Sequence:     5'-...AXXXXXXXXXXXXXXXXXXXX...-3'
DsiRNAmm Sense Strand:   5'-XXXXXXXXXXXXXXXXXXXXXXXDD-3'
DsiRNAmm Antisense Strand: 3'-EXXXXXXXXXXXXXXXXXXXXXXXXX-5'

Target RNA Sequence:     5'-...XAXXXXXXXXXXXXXXXXXXX...-3'
DsiRNAmm Sense Strand:   5'-XXXXXXXXXXXXXXXXXXXXXXXDD-3'
DsiRNAmm Antisense Strand: 3'-XEXXXXXXXXXXXXXXXXXXXXXXXX-5'

Target RNA Sequence:     5'-...AXXXXXXXXXXXXXXXXXXX...-3'
DsiRNAmm Sense Strand:   5'-BXXXXXXXXXXXXXXXXXXXXXXDD-3'
DsiRNAmm Antisense Strand: 3'-XXEXXXXXXXXXXXXXXXXXXXXXXX-5'

Target RNA Sequence:     5'-...XAXXXXXXXXXXXXXXXXXX...-3'
DsiRNAmm Sense Strand:   5'-XBXXXXXXXXXXXXXXXXXXXXXDD-3'
DsiRNAmm Antisense Strand: 3'-XXXEXXXXXXXXXXXXXXXXXXXXXX-5'

Target RNA Sequence:     5'-...XXAXXXXXXXXXXXXXXXXX...-3'
DsiRNAmm Sense Strand:   5'-XXBXXXXXXXXXXXXXXXXXXXXDD-3'
DsiRNAmm Antisense Strand: 3'-XXXXEXXXXXXXXXXXXXXXXXXXXX-5'

Target RNA Sequence:     5'-...XXXAXXXXXXXXXXXXXXXX...-3'
DsiRNAmm Sense Strand:   5'-XXXBXXXXXXXXXXXXXXXXXXXDD-3'
DsiRNAmm Antisense Strand: 3'-XXXXXEXXXXXXXXXXXXXXXXXXXX-5'

Target RNA Sequence:     5'-...XXXXAXXXXXXXXXXXXXXX...-3'
DsiRNAmm Sense Strand:   5'-XXXXBXXXXXXXXXXXXXXXXXXDD-3'
DsiRNAmm Antisense Strand: 3'-XXXXXXEXXXXXXXXXXXXXXXXXXX-5'

Target RNA Sequence:     5'-...XXXXXAXXXXXXXXXXXXXX...-3'
DsiRNAmm Sense Strand:   5'-XXXXXBXXXXXXXXXXXXXXXXXDD-3'
DsiRNAmm Antisense Strand: 3'-XXXXXXXEXXXXXXXXXXXXXXXXXX-5'

Target RNA Sequence:     5'-...XXXXXXAXXXXXXXXXXXXX...-3'
DsiRNAmm Sense Strand:   5'-XXXXXXBXXXXXXXXXXXXXXXXDD-3'
DsiRNAmm Antisense Strand: 3'-XXXXXXXXEXXXXXXXXXXXXXXXXX-5'

Target RNA Sequence:     5'-...XXXXXXXAXXXXXXXXXXXX...-3'
DsiRNAmm Sense Strand:   5'-XXXXXXXBXXXXXXXXXXXXXXXDD-3'
DsiRNAmm Antisense Strand: 3'-XXXXXXXXXEXXXXXXXXXXXXXXXX-5'
```

```
-continued
Target RNA Sequence:       5'-...XXXXXXXXAXXXXXXXXXXX...-3'
DsiRNAmm Sense Strand:     5'-XXXXXXXXBXXXXXXXXXXXXXXDD-3'
DsiRNAmm Antisense Strand: 3'-XXXXXXXXXXEXXXXXXXXXXXXXXXX-5'
``` wherein "X"=RNA, "D"=DNA and "E"=Nucleic acid residues (RNA, DNA or non-natural or modified nucleic acids) that do not base pair (hydrogen bond) with corresponding "A" RNA residues of otherwise complementary (target) strand when strands are annealed, yet optionally do base pair with corresponding "B" residues ("B" residues are also RNA, DNA or non-natural or modified nucleic acids). Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNA agents.

In certain embodiments, the guide strand of a dsRNA of the invention that is sufficiently complementary to a target RNA (e.g., mRNA) along at least 19 nucleotides of the target gene sequence to reduce target gene expression is not perfectly complementary to the at least 19 nucleotide long target gene sequence. Rather, it is appreciated that the guide strand of a dsRNA of the invention that is sufficiently complementary to a target mRNA along at least 19 nucleotides of a target RNA sequence to reduce target gene expression can have one, two, three, or even four or more nucleotides that are mismatched with the 19 nucleotide or longer target strand sequence. Thus, for a 19 nucleotide target RNA sequence, the guide strand of a dsRNA of the invention can be sufficiently complementary to the target RNA sequence to reduce target gene levels while possessing, e.g., only 15/19, 16/19, 17/19 or 18/19 matched nucleotide residues between guide strand and target RNA sequence.

In addition to the above-exemplified structures, dsRNAs of the invention can also possess one, two or three additional residues that form further mismatches with the target transthyretin RNA sequence. Such mismatches can be consecutive, or can be interspersed by nucleotides that form matched base pairs with the target transthyretin RNA sequence. Where interspersed by nucleotides that form matched base pairs, mismatched residues can be spaced apart from each other within a single strand at an interval of one, two, three, four, five, six, seven or even eight base paired nucleotides between such mismatch-forming residues.

As for the above-described DsiRNAmm agents, a preferred location within dsRNAs (e.g., DsiRNAs) for antisense strand nucleotides that form mismatched base pairs with target transthyretin RNA sequence (yet may or may not form mismatches with corresponding sense strand nucleotides) is within the antisense strand region that is located 3' (downstream) of the antisense strand sequence which is complementary to the projected Ago2 cut site of the DsiRNA (e.g., in FIG. 1, the region of the antisense strand which is 3' of the projected Ago2 cut site is preferred for mismatch-forming residues and happens to be located at positions 17-23 of the antisense strand for the 25/27 mer agent shown in FIG. 1). Thus, in one embodiment, the position of a mismatch nucleotide (in relation to the target transthyretin RNA sequence) of the antisense strand of a DsiRNAmm is the nucleotide residue of the antisense strand that is located immediately 3' (downstream) within the antisense strand sequence of the projected Ago2 cleavage site of the corresponding target transthyretin RNA sequence. In other preferred embodiments, a mismatch nucleotide of the antisense strand of a DsiRNAmm (in relation to the target transthyretin RNA sequence) is positioned at the nucleotide residue of the antisense strand that is located two nucleotides 3' (downstream) of the corresponding projected Ago2 cleavage site, three nucleotides 3' (downstream) of the corresponding projected Ago2 cleavage site, four nucleotides 3' (downstream) of the corresponding projected Ago2 cleavage site, five nucleotides 3' (downstream) of the corresponding projected Ago2 cleavage site, six nucleotides 3' (downstream) of the projected Ago2 cleavage site, seven nucleotides 3' (downstream) of the projected Ago2 cleavage site, eight nucleotides 3' (downstream) of the projected Ago2 cleavage site, or nine nucleotides 3' (downstream) of the projected Ago2 cleavage site.

In dsRNA agents possessing two mismatch-forming nucleotides of the antisense strand (where mismatch-forming nucleotides are mismatch forming in relation to target transthyretin RNA sequence), mismatches can occur consecutively (e.g., at consecutive positions along the antisense strand nucleotide sequence). Alternatively, nucleotides of the antisense strand that form mismatched base pairs with the target transthyretin RNA sequence can be interspersed by nucleotides that base pair with the target transthyretin RNA sequence (e.g., for a DsiRNA possessing mismatch-forming nucleotides at positions 17 and 20 (starting from the 5' terminus (position 1) of the antisense strand of the 25/27 mer agent shown in FIG. 1), but not at positions 18 and 19, the mismatched residues of sense strand positions 17 and 20 are interspersed by two nucleotides that form matched base pairs with corresponding residues of the target transthyretin RNA sequence). For example, two residues of the antisense strand (located within the mismatch-tolerant region of the antisense strand) that form mismatched base pairs with the corresponding target transthyretin RNA sequence can occur with zero, one, two, three, four or five matched base pairs (with respect to target transthyretin RNA sequence) located between these mismatch-forming base pairs.

For certain dsRNAs possessing three mismatch-forming base pairs (mismatch-forming with respect to target transthyretin RNA sequence), mismatch-forming nucleotides can occur consecutively (e.g., in a triplet along the antisense strand nucleotide sequence). Alternatively, nucleotides of the antisense strand that form mismatched base pairs with the target transthyretin RNA sequence can be interspersed by nucleotides that form matched base pairs with the target transthyretin RNA sequence (e.g., for a DsiRNA possessing mismatched nucleotides at positions 17, 18 and 22, but not at positions 19, 20 and 21, the mismatch-forming residues of antisense strand positions 17 and 18 are adjacent to one another, while the mismatch-forming residues of antisense strand positions 18 and 22 are interspersed by three nucleotides that form matched base pairs with corresponding residues of the target transthyretin RNA). For example, three residues of the antisense strand (located within the mismatch-tolerant region of the antisense strand) that form mismatched base pairs with the corresponding target transthyretin RNA sequence can occur with zero, one, two, three or four matched base pairs located between any two of these mismatch-forming base pairs.

For certain dsRNAs possessing four mismatch-forming base pairs (mismatch-forming with respect to target transthyretin RNA sequence), mismatch-forming nucleotides can occur consecutively (e.g., in a quadruplet along the sense strand nucleotide sequence). Alternatively, nucleotides of the antisense strand that form mismatched base pairs with the target transthyretin RNA sequence can be interspersed by nucleotides that form matched base pairs with the target transthyretin RNA sequence (e.g., for a DsiRNA possessing mismatch-forming nucleotides at positions 17, 19, 21 and 22, but not at positions 18 and 20, the mismatch-forming residues of antisense strand positions 21 and 22 are adjacent to one another, while the mismatch-forming residues of antisense strand positions 17 and 19 are interspersed by one nucleotide that forms a matched base pair with the corresponding residue of the target transthyretin RNA sequence—similarly, the mismatch-forming residues of antisense strand positions 19 and 21 are also interspersed by one nucleotide that forms a matched base pair with the corresponding residue of the target transthyretin RNA sequence). For example, four residues of the antisense strand (located within the mismatch-tolerant region of the antisense strand) that form mismatched base pairs with the corresponding target transthyretin RNA sequence can occur with zero, one, two or three matched base pairs located between any two of these mismatch-forming base pairs.

The above DsiRNAmm and other dsRNA structures are described in order to exemplify certain structures of DsiRNAmm and dsRNA agents. Design of the above DsiRNAmm and dsRNA structures can be adapted to generate, e.g., DsiRNAmm forms of other DsiRNA structures shown infra. As exemplified above, dsRNAs can also be designed that possess single mismatches (or two, three or four mismatches) between the antisense strand of the dsRNA and a target sequence, yet optionally can retain perfect complementarity between sense and antisense strand sequences of a dsRNA.

It is further noted that the dsRNA agents exemplified infra can also possess insertion/deletion (in/del) structures within their double-stranded and/or target transthyretin RNA-aligned structures. Accordingly, the dsRNAs of the invention can be designed to possess in/del variations in, e.g., antisense strand sequence as compared to target transthyretin RNA sequence and/or antisense strand sequence as compared to sense strand sequence, with preferred location(s) for placement of such in/del nucleotides corresponding to those locations described above for positioning of mismatched and/or mismatch-forming base pairs.

It is also noted that the DsiRNAs of the instant invention can tolerate mismatches within the 3'-terminal region of the sense strand/5'-terminal region of the antisense strand, as this region is modeled to be processed by Dicer and liberated from the guide strand sequence that loads into RISC. Exemplary DsiRNA structures of the invention that harbor such mismatches include the following:

```
Target RNA Sequence:    5'-...XXXXXXXXXXXXXXXXXXXXXHXXX...-3'
DsiRNA Sense Strand:    5'-XXXXXXXXXXXXXXXXXXXXXIXDD-3'
DsiRNA Antisense Strand: 3'-XXXXXXXXXXXXXXXXXXXXXXXXJXXX-5'

Target RNA Sequence:    5'-...XXXXXXXXXXXXXXXXXXXXXHXX...-3'
DsiRNA Sense Strand:    5'-XXXXXXXXXXXXXXXXXXXXXIDD-3'
DsiRNA Antisense Strand: 3'-XXXXXXXXXXXXXXXXXXXXXXXXJXX-5'

Target RNA Sequence:    5'-...XXXXXXXXXXXXXXXXXXXXXHX...-3'
DsiRNA Sense Strand:    5'-XXXXXXXXXXXXXXXXXXXXXID-3'
DsiRNA Antisense Strand: 3'-XXXXXXXXXXXXXXXXXXXXXXXXJX-5'

Target RNA Sequence:    5'-...XXXXXXXXXXXXXXXXXXXXXH...-3'
DsiRNA Sense Strand:    5'-XXXXXXXXXXXXXXXXXXXXXDI-3'
DsiRNA Antisense Strand: 3'-XXXXXXXXXXXXXXXXXXXXXXXXJ-5'
``` wherein "X"=RNA, "D"=DNA and "I" and "J"=Nucleic acid residues (RNA, DNA or non-natural or modified nucleic acids) that do not base pair (hydrogen bond) with one another, yet optionally "J" is complementary to target RNA sequence nucleotide "H". Any of the residues of such agents can optionally be 2'-O-methyl RNA monomers—alternating positioning of 2'-O-methyl RNA monomers that commences from the 3'-terminal residue of the bottom (second) strand, as shown above—or any of the above-described methylation patterns—can also be used in the above DsiRNA agents. The above mismatches can also be combined within the DsiRNAs of the instant invention.

In the below exemplary structures, such mismatches are introduced within the asymmetric TTR-242 DsiRNA (newly-introduced mismatch residues are italicized):

TTR-242 25/27 Mer DsiRNA, Mismatch Position=19 of Sense Strand (from 5'-Terminus)

```
5'-UCCAAGUGUCCUCUGAUG^AUCAAag-3'    (SEQ ID NO: 3460)
3'-UUAGGUUCACAGGAGACUAC_CAGUUUC-5'  (SEQ ID NO: 443)
```

Optionally, the mismatched 'A' residue of position 19 of the sense strand is alternatively 'U' or 'C'.

TTR-242 25/27 Mer DsiRNA, Mismatch Position=20 of Sense Strand (from 5'-Terminus)

```
5'-UCCAAGUGUCCUCUGAUGG^ACAAag-3'    (SEQ ID NO: 3461)
3'-UUAGGUUCACAGGAGACUACC_AGUUUC-5'  (SEQ ID NO: 443)
```

Optionally, the mismatched 'A' residue of position 20 of the sense strand is alternatively 'C' or 'G'.

TTR-242 25/27 Mer DsiRNA, Mismatch Position=21 of Sense Strand (from 5'-Terminus)

```
5'-UCCAAGUGUCCUCUGAUGGU^AAAag-3'    (SEQ ID NO: 3462)
3'-UUAGGUUCACAGGAGACUACCA_GUUUC-5'  (SEQ ID NO: 443)
```

Optionally, the mismatched 'A' residue of position 21 of the sense strand is alternatively 'U' or 'G'.

TTR-242 25/27 Mer DsiRNA, Mismatch Position=22 of Sense Strand (from 5'-Terminus)

```
5'-UCCAAGUGUCCUCUGAUGGUC^GAag-3'    (SEQ ID NO: 3463)
3'-UUAGGUUCACAGGAGACUACCAG_UUUC-5'  (SEQ ID NO: 443)
```

Optionally, the mismatched 'G' residue of position 22 of the sense strand is alternatively 'U' or 'C'.

TTR-242 25/27 Mer DsiRNA, Mismatch Position=23 of Sense Strand (from 5'-Terminus)

```
5'-UCCAAGUGUCCUCUGAUGGUCA^Uag-3'    (SEQ ID NO: 3464)
3'-UUAGGUUCACAGGAGACUACCAGU_UUC-5'  (SEQ ID NO: 443)
```

Optionally, the mismatched 'U' residue of position 23 of the sense strand is alternatively 'C' or 'G'.

TTR-242 25/27 Mer DsiRNA, Mismatch Position=24 of Sense Strand (from 5'-Terminus)

```
5'-UCCAAGUGUCCUCUGAUGGUCAA^gg-3'    (SEQ ID NO: 3465)
3'-UUAGGUUCACAGGAGACUACCAGUU_UC-5'  (SEQ ID NO: 443)
```

Optionally, the mismatched 'g' residue of position 24 of the sense strand is alternatively 't' or 'c'.

TTR-242 25/27 Mer DsiRNA, Mismatch Position=25 of Sense Strand (from 5'-Terminus)

```
5'-UCCAAGUGUCCUCUGAUGGUCAa^a-3'     (SEQ ID NO: 3466)
3'-UUAGGUUCACAGGAGACUACCAGUUU_C-5'  (SEQ ID NO: 443)
```

Optionally, the mismatched 'a' residue of position 25 of the sense strand is alternatively 't' or 'c'.

TTR-242 25/27 Mer DsiRNA, Mismatch Position=1 of Antisense Strand (from 5'-Terminus)

```
5'-UCCAAGUGUCCUCUGAUGGUCAAa^g-3'    (SEQ ID NO: 59)
3'-UUAGGUUCACAGGAGACUACCAGUUU_U-5'  (SEQ ID NO: 3467)
```

Optionally, the mismatched 'U' residue of position 1 of the antisense strand is alternatively 'A' or 'G'.

TTR-242 25/27 Mer DsiRNA, Mismatch Position=2 of Antisense Strand (from 5'-Terminus)

```
5'-UCCAAGUGUCCUCUGAUGGUCAA^ag-3'    (SEQ ID NO: 59)
3'-UUAGGUUCACAGGAGACUACCAGUU_CC-5'  (SEQ ID NO: 3468)
```

Optionally, the mismatched 'C' residue of position 2 of the antisense strand is alternatively 'A' or 'G'.

TTR-242 25/27 Mer DsiRNA, Mismatch Position=3 of Antisense Strand (from 5'-Terminus)

```
5'-UCCAAGUGUCCUCUGAUGGUCA^Aag-3'    (SEQ ID NO: 59)
3'-UUAGGUUCACAGGAGACUACCAGU_AUC-5'  (SEQ ID NO: 3469)
```

Optionally, the mismatched 'A' residue of position 3 of the antisense strand is alternatively 'C' or 'G'.

TTR-242 25/27 Mer DsiRNA, Mismatch Position=4 of Antisense Strand (from 5'-Terminus)

```
5'-UCCAAGUGUCCUCUGAUGGUCA^Aag-3'    (SEQ ID NO: 59)
3'-UUAGGUUCACAGGAGACUACCAG_AUUC-5'  (SEQ ID NO: 3470)
```

Optionally, the mismatched 'C' residue of position 4 of the antisense strand is alternatively 'A' or 'G'.

TTR-242 25/27 Mer DsiRNA, Mismatch Position=5 of Antisense Strand (from 5'-Terminus)

```
5'-UCCAAGUGUCCUCUGAUGGU^CAAag-3'    (SEQ ID NO: 59)
3'-UUAGGUUCACAGGAGACUACCA_UUUC-5'   (SEQ ID NO: 3471)
```

Optionally, the mismatched 'U' residue of position 5 of the antisense strand is alternatively 'A' or 'C'.

TTR-242 25/27 Mer DsiRNA, Mismatch Position=6 of Antisense Strand (from 5'-Terminus)

```
5'-UCCAAGUGUCCUCUGAUGG^UCAAag-3'    (SEQ ID NO: 59)
3'-UUAGGUUCACAGGAGACUACC_UGUUUC-5'  (SEQ ID NO: 3472)
```

Optionally, the mismatched 'U' residue of position 6 of the antisense strand is alternatively 'C' or 'G'.

TTR-242 25/27 Mer DsiRNA, Mismatch Position=7 of Antisense Strand (from 5'-Terminus)

```
5'-UCCAAGUGUCCUCUGAUG^GUCAAag-3'    (SEQ ID NO: 59)
3'-UUAGGUUCACAGGAGACUAC_UAGUUUC-5'  (SEQ ID NO: 3473)
```

Optionally, the mismatched 'U' residue of position 7 of the antisense strand is alternatively 'A' or 'G'.

For the above oligonucleotide strand sequences, it is contemplated that the sense strand sequence of one depicted duplex can be combined with an antisense strand of another depicted duplex, thereby forming a distinct duplex—in certain instances, such duplexes contain a mismatched residue with respect to the transthyretin target transcript sequence, while such sense and antisense strand sequences do not present a mismatch at this residue with respect to one another (e.g., duplexes comprising SEQ ID NOs: 3466 and 3467; SEQ ID NOs: 3465 and 3468; SEQ ID NOs: 3464 and 3469, etc., are contemplated as exemplary of such duplexes).

As noted above, introduction of mismatches can be performed upon any of the DsiRNAs described herein.

The mismatches of such DsiRNA structures can be combined to produce a DsiRNA possessing, e.g., two, three or even four mismatches within the 3'-terminal four to seven nucleotides of the sense strand/5'-terminal four to seven nucleotides of the antisense strand.

Indeed, in view of the flexibility of sequences which can be incorporated into DsiRNAs at the 3'-terminal residues of the sense strand/5'-terminal residues of the antisense strand, in certain embodiments, the sequence requirements of an asymmetric DsiRNA of the instant invention can be represented as the following (minimalist) structure (shown for an exemplary transthyretin-439 DsiRNA sequence):

```
                                        (SEQ ID NO: 3474)
    5'-AGACACCAAAUCUUACUGXXXXXX[X]ₙ-3'
                                        (SEQ ID NO: 3475)
    3'-UAUCUGUGGUUUAGAAUGACXXXXXX[X]ₙ-5'
``` where n=1 to 5, 1 to 10, 1 to 20, 1 to 30, 1 to 50, or 1 to 80 or more.
transthyretin-439 mRNA Target: 5'-AUAGACAC-CAAAUCUUACUGXXXXXXX-3' (SEQ ID NO: 3476).

The transthyretin target site may also be a site which is targeted by one or more of several oligonucleotides whose complementary target sites overlap with a stated target site. For example, for an exemplary transthyretin-245 DsiRNA, it is noted that certain DsiRNAs targeting overlapping and only slightly offset transthyretin sequences could exhibit activity levels similar to that of transthyretin-245 (e.g., transthyretin-242 to 246 of Table 2 above). Thus, in certain embodiments, a designated target sequence region might be effectively targeted by a series of DsiRNAs possessing largely overlapping sequences. (E.g., if considering DsiRNAs of the transthyretin-242 to transthyretin-246 target site(s), a more encompassing transthyretin transcript target sequence might be recited as, e.g., 5'-AAUCCAAGUGUC-CUCUGAUGGUCAAAGUUCU-3' (SEQ ID NO: 3477), wherein any given DsiRNA (e.g., a DsiRNA selected from transthyretin-238 to transthyretin-246) only targets a subsequence within such a sequence region, yet the entire sequence can be considered a viable target for such a series of DsiRNAs).

Additionally and/or alternatively, mismatches within the 3'-terminal seven nucleotides of the sense strand/5'-terminal seven nucleotides of the antisense strand can be combined with mismatches positioned at other mismatch-tolerant positions, as described above.

In view of the present identification of the above-described Dicer substrate agents (DsiRNAs) as inhibitors of transthyretin levels via targeting of specific transthyretin sequences, it is also recognized that dsRNAs having structures similar to those described herein can also be synthesized which target other sequences within the transthyretin sequence of NM_000371.3, or within variants thereof (e.g., target sequences possessing 80% identity, 90% identity, 95% identity, 96% identity, 97% identity, 98% identity, 99% or more identity to a sequence of NM_000371.3).

Anti-Transthyretin DsiRNA Design/Synthesis

It has been found empirically that longer dsRNA species of from 25 to 35 nucleotides (DsiRNAs) and especially from 25 to 30 nucleotides give unexpectedly effective results in terms of potency and duration of action, as compared to 19-23 mer siRNA agents. Without wishing to be bound by the underlying theory of the dsRNA processing mechanism, it is thought that the longer dsRNA species serve as a substrate for the Dicer enzyme in the cytoplasm of a cell. In addition to cleaving the dsRNA of the invention into shorter segments, Dicer is thought to facilitate the incorporation of a single-stranded cleavage product derived from the cleaved dsRNA into the RISC complex that is responsible for the destruction of the cytoplasmic RNA (e.g., transthyretin RNA) of or derived from the target gene, transthyretin (or other gene associated with a transthyretin-associated disease or disorder). Prior studies (Rossi et al., U.S. Patent Application No. 2007/0265220) have shown that the cleavability of a dsRNA species (specifically, a DsiRNA agent) by Dicer corresponds with increased potency and duration of action of the dsRNA species.

Certain preferred anti-transthyretin DsiRNA agents were selected from a pre-screened population. Design of DsiRNAs can optionally involve use of predictive scoring algorithms that perform in silico assessments of the projected activity/efficacy of a number of possible DsiRNA agents spanning a region of sequence. Information regarding the design of such scoring algorithms can be found, e.g., in Gong et al. (*BMC Bioinformatics* 2006, 7:516), though a more recent "v4.3" algorithm represents a theoretically improved algorithm relative to siRNA scoring algorithms previously available in the art. (E.g., "v3" and "v4" scoring algorithms are machine learning algorithms that are not reliant upon any biases in human sequence. In addition, the "v3" and "v4" algorithms derive from data sets that are many-fold larger than that from which an older "v2" algorithm such as that described in Gong et al. derives.)

The first and second oligonucleotides of the DsiRNA agents of the instant invention are not required to be completely complementary. In fact, in one embodiment, the 3'-terminus of the sense strand contains one or more mismatches. In one aspect, two mismatches are incorporated at the 3' terminus of the sense strand. In another embodiment, the DsiRNA of the invention is a double stranded RNA molecule containing two RNA oligonucleotides each of which is 27 nucleotides in length and, when annealed to each other, have blunt ends and a two nucleotide mismatch on the 3'-terminus of the sense strand (the 5'-terminus of the antisense strand). The use of mismatches or decreased thermodynamic stability (specifically at the 3'-sense/5'-antisense position) has been proposed to facilitate or favor entry of the antisense strand into RISC (Schwarz et al., 2003, *Cell* 115: 199-208; Khvorova et al., 2003, *Cell* 115: 209-216), presumably by affecting some rate-limiting unwinding steps that occur with entry of the siRNA into RISC. Thus, terminal base composition has been included in design algorithms for selecting active 21 mer siRNA duplexes (Ui-Tei et al., 2004, *Nucleic Acids Res* 32: 936-948; Reynolds et al., 2004, *Nat Biotechnol* 22: 326-330). With Dicer cleavage of the dsRNA of this embodiment, the small end-terminal sequence which contains the mismatches will either be left unpaired with the antisense strand (become part of a 3'-overhang) or be cleaved entirely off the final 21-mer siRNA. These "mismatches", therefore, do not persist as mismatches in the final RNA component of RISC. The finding that base mismatches or destabilization of segments at the 3'-end of the sense strand of Dicer substrate improved the potency of synthetic duplexes in RNAi, presumably by facilitating processing by Dicer, was a surprising finding of past works describing the design and use of 25-30 mer dsRNAs (also termed "DsiRNAs" herein; Rossi et al., U.S. Patent Application Nos. 2005/0277610, 2005/0244858 and 2007/0265220).

Modification of Anti-Transthyretin dsRNAs

One major factor that inhibits the effect of double stranded RNAs ("dsRNAs") is the degradation of dsRNAs (e.g., siRNAs and DsiRNAs) by nucleases. A 3'-exonuclease is the primary nuclease activity present in serum and modification of the 3'-ends of antisense DNA oligonucleotides is crucial to prevent degradation (Eder et al., 1991, *Antisense Res Dev,* 1: 141-151). An RNase-T family nuclease has been identified called ERI-1 which has 3' to 5' exonuclease activity that is involved in regulation and degradation of siRNAs (Kennedy et al., 2004, *Nature* 427: 645-649; Hong et al., 2005, *Biochem J,* 390: 675-679). This gene is also known as Thex1 (NM_02067) in mice or THEX1 (NM_153332) in humans and is involved in degradation of histone mRNA; it also mediates degradation of 3'-overhangs in siRNAs, but does not degrade duplex RNA (Yang et al., 2006, *J Biol Chem,* 281: 30447-30454). It is therefore reasonable to expect that 3'-end-stabilization of dsRNAs, including the DsiRNAs of the instant invention, will improve stability.

XRN1 (NM_019001) is a 5' to 3' exonuclease that resides in P-bodies and has been implicated in degradation of mRNA targeted by miRNA (Rehwinkel et al., 2005, *RNA* 11: 1640-1647) and may also be responsible for completing degradation initiated by internal cleavage as directed by a siRNA. XRN2 (NM_012255) is a distinct 5' to 3' exonuclease that is involved in nuclear RNA processing.

RNase A is a major endonuclease activity in mammals that degrades RNAs. It is specific for ssRNA and cleaves at the 3'-end of pyrimidine bases. SiRNA degradation products consistent with RNase A cleavage can be detected by mass spectrometry after incubation in serum (Turner et al., 2007, *Mol Biosyst* 3: 43-50). The 3'-overhangs enhance the susceptibility of siRNAs to RNase degradation. Depletion of RNase A from serum reduces degradation of siRNAs; this degradation does show some sequence preference and is worse for sequences having poly A/U sequence on the ends (Haupenthal et al., 2006 *Biochem Pharmacol* 71: 702-710). This suggests the possibility that lower stability regions of the duplex may "breathe" and offer transient single-stranded species available for degradation by RNase A. RNase A inhibitors can be added to serum and improve siRNA longevity and potency (Haupenthal et al., 2007, *Int J. Cancer* 121: 206-210).

In 21 mers, phosphorothioate or boranophosphate modifications directly stabilize the internucleoside phosphate linkage. Boranophosphate modified RNAs are highly nuclease resistant, potent as silencing agents, and are relatively non-toxic. Boranophosphate modified RNAs cannot be manufactured using standard chemical synthesis methods and instead are made by in vitro transcription (IVT) (Hall et al., 2004, *Nucleic Acids Res* 32: 5991-6000; Hall et al., 2006, *Nucleic Acids Res* 34: 2773-2781). Phosphorothioate (PS) modifications can be easily placed in the RNA duplex at any desired position and can be made using standard chemical synthesis methods. The PS modification shows dose-dependent toxicity, so most investigators have recommended limited incorporation in siRNAs, favoring the 3'-ends where protection from nucleases is most important (Harborth et al., 2003, *Antisense Nucleic Acid Drug Dev* 13: 83-105; Chiu and Rana, 2003, *Mol Cell* 10: 549-561; Braasch et al., 2003, *Biochemistry* 42: 7967-7975; Amarzguioui et al., 2003, *Nucleic Acids Research* 31: 589-595). More extensive PS modification can be compatible with potent RNAi activity; however, use of sugar modifications (such as 2'-O-methyl RNA) may be superior (Choung et al., 2006, *Biochem Biophys Res Commun* 342: 919-927).

A variety of substitutions can be placed at the 2'-position of the ribose which generally increases duplex stability ($T_m$) and can greatly improve nuclease resistance. 2'-O-methyl RNA is a naturally occurring modification found in mammalian ribosomal RNAs and transfer RNAs. 2'-O-methyl modification in siRNAs is known, but the precise position of modified bases within the duplex is important to retain potency and complete substitution of 2'-O-methyl RNA for RNA will inactivate the siRNA. For example, a pattern that employs alternating 2'-O-methyl bases can have potency equivalent to unmodified RNA and is quite stable in serum (Choung et al., 2006, *Biochem Biophys Res Commun* 342: 919-927; Czauderna et al., 2003, *Nucleic Acids Research* 31: 2705-2716).

The 2'-fluoro (2'-F) modification is also compatible with dsRNA (e.g., siRNA and DsiRNA) function; it is most commonly placed at pyrimidine sites (due to reagent cost and availability) and can be combined with 2'-O-methyl modification at purine positions; 2'-F purines are available and can also be used. Heavily modified duplexes of this kind can be potent triggers of RNAi in vitro (Allerson et al., 2005, *J Med Chem* 48: 901-904; Prakash et al., 2005, *J Med Chem* 48: 4247-4253; Kraynack and Baker, 2006, RNA 12: 163-176) and can improve performance and extend duration of action when used in vivo (Morrissey et al., 2005, *Hepatology* 41: 1349-1356; Morrissey et al., 2005, *Nat Biotechnol* 23: 1002-1007). A highly potent, nuclease stable, blunt 19 mer duplex containing alternative 2'-F and 2'-O-Me bases is taught by Allerson. In this design, alternating 2'-O-Me residues are positioned in an identical pattern to that employed by Czauderna, however the remaining RNA residues are converted to 2'-F modified bases. A highly potent, nuclease resistant siRNA employed by Morrissey employed a highly potent, nuclease resistant siRNA in vivo. In addition to 2'-O-Me RNA and 2'-F RNA, this duplex includes DNA, RNA, inverted abasic residues, and a 3'-terminal PS internucleoside linkage. While extensive modification has certain benefits, more limited modification of the duplex can also improve in vivo performance and is both simpler and less costly to manufacture. Soutschek et al. (2004, *Nature* 432: 173-178) employed a duplex in vivo and was mostly RNA with two 2'-O-Me RNA bases and limited 3'-terminal PS internucleoside linkages.

Locked nucleic acids (LNAs) are a different class of 2'-modification that can be used to stabilize dsRNA (e.g., siRNA and DsiRNA). Patterns of LNA incorporation that retain potency are more restricted than 2'-O-methyl or 2'-F bases, so limited modification is preferred (Braasch et al., 2003, *Biochemistry* 42: 7967-7975; Grunweller et al., 2003, *Nucleic Acids Res* 31: 3185-3193; Elmen et al., 2005, *Nucleic Acids Res* 33: 439-447). Even with limited incorporation, the use of LNA modifications can improve dsRNA performance in vivo and may also alter or improve off target effect profiles (Mook et al., 2007, *Mol Cancer Ther* 6: 833-843).

Synthetic nucleic acids introduced into cells or live animals can be recognized as "foreign" and trigger an immune response. Immune stimulation constitutes a major class of off-target effects which can dramatically change experimental results and even lead to cell death. The innate immune system includes a collection of receptor molecules that specifically interact with DNA and RNA that mediate these responses, some of which are located in the cytoplasm and some of which reside in endosomes (Marques and Williams, 2005, *Nat Biotechnol* 23: 1399-1405; Schlee et al., 2006, *Mol Ther* 14: 463-470). Delivery of siRNAs by cationic lipids or liposomes exposes the siRNA to both cytoplasmic and endosomal compartments, maximizing the risk for triggering a type 1 interferon (IFN) response both in vitro and in vivo (Morrissey et al., 2005, *Nat Biotechnol* 23: 1002-1007; Sioud and Sorensen, 2003, *Biochem Biophys Res Commun* 312: 1220-1225; Sioud, 2005, *J Mol Biol* 348: 1079-1090; Ma et al., 2005, *Biochem Biophys Res Commun* 330: 755-759). RNAs transcribed within the cell are less immunogenic (Robbins et al., 2006, *Nat Biotechnol* 24: 566-571) and synthetic RNAs that are immunogenic when delivered using lipid-based methods can evade immune stimulation when introduced unto cells by mechanical means, even in vivo (Heidel et al., 2004, *Nat Biotechnol* 22: 1579-1582). However, lipid based delivery methods are convenient, effective, and widely used. Some general strategy to prevent immune responses is needed, especially for in vivo application where all cell types are present and the risk of generating an immune response is highest. Use of chemically modified RNAs may solve most or even all of these problems.

In certain embodiments, modifications can be included in the anti-transthyretin dsRNA agents of the present invention so long as the modification does not prevent the dsRNA agent from possessing transthyretin inhibitory activity. In one embodiment, one or more modifications are made that enhance Dicer processing of the DsiRNA agent (an assay for determining Dicer processing of a DsiRNA is described elsewhere herein). In a second embodiment, one or more modifications are made that result in more effective transthyretin inhibition (as described herein, transthyretin inhibition/transthyretin inhibitory activity of a dsRNA can be assayed via art-recognized methods for determining RNA levels, or for determining transthyretin polypeptide levels, should such levels be assessed in lieu of or in addition to assessment of, e.g., transthyretin mRNA levels). In a third embodiment, one or more modifications are made that support greater transthyretin inhibitory activity (means of determining transthyretin inhibitory activity are described supra). In a fourth embodiment, one or more modifications are made that result in greater potency of transthyretin inhibitory activity per each dsRNA agent molecule to be delivered to the cell (potency of transthyretin inhibitory activity is described supra). Modifications can be incorporated in the 3'-terminal region, the 5'-terminal region, in both the 3'-terminal and 5'-terminal region or in some instances in various positions within the sequence. With the restrictions noted above in mind, numbers and combinations of modifications can be incorporated into the dsRNA agent. Where multiple modifications are present, they may be the same or different. Modifications to bases, sugar moieties, the phosphate backbone, and their combinations are contemplated. Either 5'-terminus can be phosphorylated.

Examples of modifications contemplated for the phosphate backbone include phosphonates, including methylphosphonate, phosphorothioate, and phosphotriester modifications such as alkylphosphotriesters, and the like. Examples of modifications contemplated for the sugar moiety include 2'-alkyl pyrimidine, such as 2'-O-methyl, 2'-fluoro, amino, and deoxy modifications and the like (see, e.g., Amarzguioui et al., 2003, *Nucleic Acids Research* 31: 589-595). Examples of modifications contemplated for the base groups include abasic sugars, 2-O-alkyl modified pyrimidines, 4-thiouracil, 5-bromouracil, 5-iodouracil, and 5-(3-aminoallyl)-uracil and the like. Locked nucleic acids, or LNA's, could also be incorporated. Many other modifications are known and can be used so long as the above criteria are satisfied. Examples of modifications are also disclosed in U.S. Pat. Nos. 5,684,143, 5,858,988 and 6,291,438 and in U.S. published patent application No. 2004/0203145 A1. Other modifications are disclosed in Herdewijn (2000, *Antisense Nucleic Acid Drug Dev* 10: 297-310), Eckstein (2000, *Antisense Nucleic Acid Drug Dev* 10: 117-21), Rusckowski et al. (2000, *Antisense Nucleic Acid Drug Dev* 10: 333-345), Stein et al. (2001, *Antisense Nucleic Acid Drug Dev* 11: 317-25); Vorobjev et al. (2001, *Antisense Nucleic Acid Drug Dev* 11: 77-85).

One or more modifications contemplated can be incorporated into either strand. The placement of the modifications in the dsRNA agent can greatly affect the characteristics of the dsRNA agent, including conferring greater potency and stability, reducing toxicity, enhance Dicer processing, and minimizing an immune response. In one embodiment, the antisense strand or the sense strand or both strands have one or more 2'-O-methyl modified nucleotides. In another embodiment, the antisense strand contains 2'-O-methyl modified nucleotides. In another embodiment, the antisense stand contains a 3' overhang that is comprised of 2'-O-methyl modified nucleotides. The antisense strand could also include additional 2'-O-methyl modified nucleotides.

In certain embodiments, the anti-transthyretin DsiRNA agent of the invention has several properties which enhance its processing by Dicer. According to such embodiments, the DsiRNA agent has a length sufficient such that it is processed by Dicer to produce an siRNA and at least one of the following properties: (i) the DsiRNA agent is asymmetric, e.g., has a 3' overhang on the sense strand and (ii) the DsiRNA agent has a modified 3' end on the antisense strand to direct orientation of Dicer binding and processing of the dsRNA to an active siRNA. According to these embodiments, the longest strand in the DsiRNA agent comprises 25-30 nucleotides. In one embodiment, the sense strand comprises 25-30 nucleotides and the antisense strand comprises 25-28 nucleotides. Thus, the resulting dsRNA has an overhang on the 3' end of the sense strand. The overhang is 1-4 nucleotides, such as 2 nucleotides. The antisense strand may also have a 5' phosphate.

In certain embodiments, the sense strand of a DsiRNA agent is modified for Dicer processing by suitable modifiers located at the 3' end of the sense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the sense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the sense strand in place of two ribonucleotides forming a blunt end of the duplex on the 5' end of the antisense strand and the 3' end of the sense strand, and a two-nucleotide RNA overhang is located on the 3'-end of the antisense strand. This is an asymmetric composition with DNA on the blunt end and RNA bases on the overhanging end.

In certain other embodiments, the antisense strand of a DsiRNA agent is modified for Dicer processing by suitable modifiers located at the 3' end of the antisense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the antisense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the antisense strand in place of two ribonucleotides forming a blunt end of the duplex on the 5' end of the sense strand and the 3' end of the antisense strand, and a two-nucleotide RNA overhang is located on the 3'-end of the sense strand. This is also an asymmetric composition with DNA on the blunt end and RNA bases on the overhanging end.

The sense and antisense strands anneal under biological conditions, such as the conditions found in the cytoplasm of a cell. In addition, a region of one of the sequences, particularly of the antisense strand, of the dsRNA has a sequence length of at least 19 nucleotides, wherein these nucleotides are adjacent to the 3' end of antisense strand and are sufficiently complementary to a nucleotide sequence of the target transthyretin RNA.

Additionally, the DsiRNA agent structure can be optimized to ensure that the oligonucleotide segment generated from Dicer's cleavage will be the portion of the oligonucleotide that is most effective in inhibiting gene expression. For example, in one embodiment of the invention, a 27-bp oligonucleotide of the DsiRNA agent structure is synthesized wherein the anticipated 21 to 22-bp segment that will inhibit gene expression is located on the 3'-end of the antisense strand. The remaining bases located on the 5'-end of the antisense strand will be cleaved by Dicer and will be discarded. This cleaved portion can be homologous (i.e., based on the sequence of the target sequence) or non-homologous and added to extend the nucleic acid strand.

US 2007/0265220 discloses that 27 mer DsiRNAs showed improved stability in serum over comparable 21 mer siRNA compositions, even absent chemical modification. Modifications of DsiRNA agents, such as inclusion of 2'-O-methyl RNA in the antisense strand, in patterns such as detailed above, when coupled with addition of a 5' Phosphate, can improve stability of DsiRNA agents. Addition of 5'-phosphate to all strands in synthetic RNA duplexes may be an inexpensive and physiological method to confer some limited degree of nuclease stability.

The chemical modification patterns of the dsRNA agents of the instant invention are designed to enhance the efficacy of such agents. Accordingly, such modifications are designed to avoid reducing potency of dsRNA agents; to avoid interfering with Dicer processing of DsiRNA agents; to improve stability in biological fluids (reduce nuclease sensitivity) of dsRNA agents; or to block or evade detection by the innate immune system. Such modifications are also designed to avoid being toxic and to avoid increasing the cost or impact the ease of manufacturing the instant dsRNA agents of the invention.

In certain embodiments of the present invention, an anti-transthyretin DsiRNA agent has one or more of the following properties: (i) the DsiRNA agent is asymmetric, e.g., has a 3' overhang on the antisense strand and (ii) the DsiRNA agent has a modified 3' end on the sense strand to direct orientation of Dicer binding and processing of the dsRNA to an active siRNA. According to this embodiment, the longest strand in the dsRNA comprises 25-35 nucleotides (e.g., 25, 26, 27, 28, 29, 30, 31, 32, 33, 34 or 35 nucleotides). In certain such embodiments, the DsiRNA agent is asymmetric such that the sense strand comprises 25-34 nucleotides and the 3' end of the sense strand forms a blunt end with the 5' end of the antisense strand while the antisense strand comprises 26-35 nucleotides and forms an overhang on the 3' end of the antisense strand. In one embodiment, the DsiRNA agent is asymmetric such that the sense strand comprises 25-28 nucleotides and the antisense strand comprises 25-30 nucleotides. Thus, the resulting dsRNA has an overhang on the 3' end of the antisense strand. The overhang is 1-4 nucleotides, for example 2 nucleotides. The sense strand may also have a 5' phosphate.

The DsiRNA agent can also have one or more of the following additional properties: (a) the antisense strand has a right shift from the typical 21 mer (e.g., the DsiRNA comprises a length of antisense strand nucleotides that extends to the 5' of a projected Dicer cleavage site within the DsiRNA, with such antisense strand nucleotides base paired with corresponding nucleotides of the sense strand extending 3' of a projected Dicer cleavage site in the sense strand), (b) the strands may not be completely complementary, i.e., the strands may contain simple mismatched base pairs (in certain embodiments, the DsiRNAs of the invention possess 1, 2, 3, 4 or even 5 or more mismatched base pairs, provided that transthyretin inhibitory activity of the DsiRNA possessing mismatched base pairs is retained at sufficient levels (e.g., retains at least 50% transthyretin inhibitory activity or more, at least 60% transthyretin inhibitory activity or more, at least 70% transthyretin inhibitory activity or more, at least 80% transthyretin inhibitory activity or more, at least 90% transthyretin inhibitory activity or more or at least 95% transthyretin inhibitory activity or more as compared to a corresponding DsiRNA not possessing mismatched base pairs. In certain embodiments, mismatched base pairs exist between the antisense and sense strands of a DsiRNA. In some embodiments, mismatched base pairs exist (or are predicted to exist) between the antisense strand and the target RNA. In certain embodiments, the presence of a mismatched base pair(s) between an antisense strand residue and a corresponding residue within the target RNA that is located 3' in the target RNA sequence of a projected Ago2 cleavage site retains and may even enhance transthyretin inhibitory activity of a DsiRNA of the invention) and (c) base modifications such as locked nucleic acid(s) may be included in the 5' end of the sense strand. A "typical" 21 mer siRNA is designed using conventional techniques. In one technique, a variety of sites are commonly tested in parallel or pools containing several distinct siRNA duplexes specific to the same target with the hope that one of the reagents will be effective (Ji et al., 2003, *FEBS Lett* 552: 247-252). Other techniques use design rules and algorithms to increase the likelihood of obtaining active RNAi effector molecules (Schwarz et al., 2003, *Cell* 115: 199-208; Khvorova et al., 2003, *Cell* 115: 209-216; Ui-Tei et al., 2004, *Nucleic Acids Res* 32: 936-948; Reynolds et al., 2004, *Nat Biotechnol* 22: 326-330; Krol et al., 2004, *J Biol Chem* 279: 42230-42239; Yuan et al., 2004, *Nucl Acids Res* 32 (Webserver issue): W130-134; Boese et al., 2005, *Methods Enzymol* 392: 73-96). High throughput selection of siRNA has also been developed (U.S. published patent application No. 2005/0042641 A1). Potential target sites can also be analyzed by secondary structure predictions (Heale et al., 2005, *Nucleic Acids Res* 33(3): e30). This 21 mer is then used to design a right shift to include 3-9 additional nucleotides on the 5' end of the 21 mer. The sequence of these additional nucleotides is not restricted. In one embodiment, the added ribonucleotides are based on the sequence of the target gene. Even in this embodiment, full complementarity between the target sequence and the antisense siRNA is not required.

The first and second oligonucleotides of a DsiRNA agent of the instant invention are not required to be completely complementary. They only need to be sufficiently complementary to anneal under biological conditions and to provide a substrate for Dicer that produces a siRNA sufficiently complementary to the target sequence. Locked nucleic acids, or LNA's, are well known to a skilled artisan (Elmen et al., 2005, *Nucleic Acids Res* 33: 439-447; Kurreck et al., 2002, *Nucleic Acids Res* 30: 1911-1918; Crinelli et al., 2002, *Nucleic Acids Res* 30: 2435-2443; Braasch and Corey, 2001, *Chem Biol* 8: 1-7; Bondensgaard et al., 2000, *Chemistry* 6: 2687-2695; Wahlestedt et al., 2000, *Proc Natl Acad Sci USA* 97: 5633-5638). In one embodiment, an LNA is incorporated at the 5' terminus of the sense strand. In another embodiment, an LNA is incorporated at the 5' terminus of the sense strand in duplexes designed to include a 3' overhang on the antisense strand.

In certain embodiments, the DsiRNA agent of the instant invention has an asymmetric structure, with the sense strand having a 25-base pair length, and the antisense strand having a 27-base pair length with a 2 base 3'-overhang. In other embodiments, this DsiRNA agent having an asymmetric structure further contains 2 deoxynucleotides at the 3' end of the sense strand in place of two of the ribonucleotides.

Certain DsiRNA agent compositions containing two separate oligonucleotides can be linked by a third structure. The third structure will not block Dicer activity on the DsiRNA agent and will not interfere with the directed destruction of the RNA transcribed from the target gene. In one embodiment, the third structure may be a chemical linking group. Many suitable chemical linking groups are known in the art and can be used. Alternatively, the third structure may be an oligonucleotide that links the two oligonucleotides of the DsiRNA agent in a manner such that a hairpin structure is produced upon annealing of the two oligonucleotides making up the dsRNA composition. The hairpin structure will not block Dicer activity on the DsiRNA agent and will not interfere with the directed destruction of the transthyretin RNA.

Transthyretin cDNA and Polypeptide Sequences

Known human and mouse transthyretin cDNA and polypeptide sequences include the following: human transthyretin NM_000371.3 and corresponding human transthyretin polypeptide sequence GenBank Accession No. NP_000362.1; and mouse wild-type transthyretin sequence GenBank Accession No. NM_013697.5 (*Mus musculus* C57BL/6 Transthyretin) and corresponding mouse transthyretin sequence GenBank Accession No. NP_038725.1.

In Vitro Assay to Assess dsRNA Transthyretin Inhibitory Activity

An in vitro assay that recapitulates RNAi in a cell-free system can be used to evaluate dsRNA constructs targeting transthyretin RNA sequence(s), and thus to assess transthyretin-specific gene inhibitory activity (also referred to herein as transthyretin inhibitory activity) of a dsRNA. The assay comprises the system described by Tuschl et al., 1999, *Genes and Development*, 13, 3191-3197 and Zamore et al., 2000, *Cell*, 101, 25-33 adapted for use with dsRNA (e.g., DsiRNA) agents directed against transthyretin RNA. A *Drosophila* extract derived from syncytial blastoderm is used to reconstitute RNAi activity in vitro. Target RNA is generated via in vitro transcription from a selected transthyretin expressing plasmid using T7 RNA polymerase or via chemical synthesis. Sense and antisense dsRNA strands (for example, 20 uM each) are annealed by incubation in buffer (such as 100 mM potassium acetate, 30 mM HEPES-KOH, pH 7.4, 2 mM magnesium acetate) for 1 minute at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The *Drosophila* lysate is prepared using zero to two-hour-old embryos from Oregon R flies collected on yeasted molasses agar that are dechorionated and lysed. The lysate is centrifuged and the supernatant isolated. The assay comprises a reaction mixture containing 50% lysate [vol/vol], RNA (10-50 pM final concentration), and 10% [vol/vol] lysis buffer containing dsRNA (10 nM final concentration). The reaction mixture also contains 10 mM creatine phosphate, 10 ug/ml creatine phosphokinase, 100 um GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and preincubated at 25° C. for 10 minutes before adding RNA, then incubated at 25° C. for an additional 60 minutes. Reactions are quenched with 4 volumes of 1.25×Passive Lysis Buffer (Promega). Target RNA cleavage is assayed by RT-PCR analysis or other methods known in the art and are compared to control reactions in which dsRNA is omitted from the reaction.

Alternately, internally-labeled target RNA for the assay is prepared by in vitro transcription in the presence of [$\alpha$-$^{32}$P] CTP, passed over a G50 Sephadex column by spin chromatography and used as target RNA without further purification. Optionally, target RNA is 5'-$^{32}$P-end labeled using T4 polynucleotide kinase enzyme. Assays are performed as described above and target RNA and the specific RNA cleavage products generated by RNAi are visualized on an autoradiograph of a gel. The percentage of cleavage is determined by PHOSPHOR IMAGER® (autoradiography) quantitation of bands representing intact control RNA or RNA from control reactions without dsRNA and the cleavage products generated by the assay.

In one embodiment, this assay is used to determine target sites in the transthyretin RNA target for dsRNA mediated RNAi cleavage, wherein a plurality of dsRNA constructs are screened for RNAi mediated cleavage of the transthyretin RNA target, for example, by analyzing the assay reaction by electrophoresis of labeled target RNA, or by northern blotting, as well as by other methodology well known in the art.

In certain embodiments, a dsRNA of the invention is deemed to possess transthyretin inhibitory activity if, e.g., a 50% reduction in transthyretin RNA levels is observed in a system, cell, tissue or organism, relative to a suitable control. Additional metes and bounds for determination of transthyretin inhibitory activity of a dsRNA of the invention are described supra.

Conjugation and Delivery of Anti-Transthyretin dsRNA Agents

In certain embodiments, the present invention relates to a method for treating a subject having a transthyretin-associated disease or disorder, or at risk of developing a transthyretin-associated disease or disorder. In such embodiments, the dsRNA can act as novel therapeutic agents for controlling the transthyretin-associated disease or disorder. The method comprises administering a pharmaceutical composition of the invention to the patient (e.g., human), such that the expression, level and/or activity of a transthyretin RNA is reduced. The expression, level and/or activity of a polypeptide encoded by a transthyretin RNA might also be reduced by a dsRNA of the instant invention, even where said dsRNA is directed against a non-coding region of the transthyretin transcript (e.g., a targeted 5' UTR or 3' UTR sequence). Because of their high specificity, the dsRNAs of the present invention can specifically target transthyretin sequences of cells and tissues, optionally in an allele-specific manner where polymorphic alleles exist within an individual and/or population.

In the treatment of a transthyretin-associated disease or disorder, the dsRNA can be brought into contact with the cells or tissue of a subject, e.g., the cells or tissue of a subject exhibiting disregulation of transthyretin and/or otherwise targeted for reduction of transthyretin levels. For example, dsRNA substantially identical to all or part of a transthyretin RNA sequence, may be brought into contact with or introduced into such a cell, either in vivo or in vitro. Similarly, dsRNA substantially identical to all or part of a transthyretin RNA sequence may administered directly to a subject having or at risk of developing a transthyretin-associated disease or disorder.

Therapeutic use of the dsRNA agents of the instant invention can involve use of formulations of dsRNA agents comprising multiple different dsRNA agent sequences. For example, two or more, three or more, four or more, five or more, etc. of the presently described agents can be combined to produce a formulation that, e.g., targets multiple different regions of the transthyretin RNA, or that not only target transthyretin RNA but also target, e.g., cellular target genes associated with a transthyretin-associated disease or disorder. A dsRNA agent of the instant invention may also be constructed such that either strand of the dsRNA agent independently targets two or more regions of transthyretin RNA, or such that one of the strands of the dsRNA agent targets a cellular target gene of transthyretin known in the art.

Use of multifunctional dsRNA molecules that target more then one region of a target nucleic acid molecule can also provide potent inhibition of transthyretin RNA levels and expression. For example, a single multifunctional dsRNA construct of the invention can target both the transthyretin-242 and transthyretin-439 sites simultaneously; additionally and/or alternatively, single or multifunctional agents of the invention can be designed to selectively target one splice variant of transthyretin over another.

Thus, the dsRNA agents of the instant invention, individually, or in combination or in conjunction with other drugs, can be used to treat, inhibit, reduce, or prevent a transthyretin-associated disease or disorder. For example, the dsRNA molecules can be administered to a subject or can be administered to other appropriate cells evident to those skilled in the art, individually or in combination with one or more drugs under conditions suitable for the treatment.

The dsRNA molecules also can be used in combination with other known treatments to treat, inhibit, reduce, or prevent a transthyretin-associated disease or disorder in a subject or organism. For example, the described molecules could be used in combination with one or more known compounds, treatments, or procedures to treat, inhibit, reduce, or prevent a transthyretin-associated disease or disorder in a subject or organism as are known in the art.

A dsRNA agent of the invention can be conjugated (e.g., at its 5' or 3' terminus of its sense or antisense strand) or unconjugated to another moiety (e.g. a non-nucleic acid moiety such as a peptide), an organic compound (e.g., a dye, cholesterol, or the like). Modifying dsRNA agents in this way may improve cellular uptake or enhance cellular targeting activities of the resulting dsRNA agent derivative as compared to the corresponding unconjugated dsRNA agent, are useful for tracing the dsRNA agent derivative in the cell, or improve the stability of the dsRNA agent derivative compared to the corresponding unconjugated dsRNA agent.

In certain embodiments, specific exemplary forms of dsRNA conjugates are contemplated. Notably, RNAi therapies, such as the dsRNAs that are specifically exemplified herein, have demonstrated particularly good ability to be delivered to the cells of the liver in vivo (via, e.g., lipid nanoparticles and/or conjugates such as dynamic polyconjugates or GalNAc conjugates—in certain exemplary embodiments, one or more GalNAc moieties can be conjugated to a 3'- and/or 5'-overhang region of a dsNA, optionally to an "extended" overhang region of a dsNA (e.g., to a 5 or more nucleotide, 8 or more nucleotide, etc. example of such an overhang); additionally and/or alternatively, one or more GalNAc moieties can be conjugated to ds extended regions of a dsNA, e.g., to the duplex region formed by the 5'-end region of the guide/antisense strand of a dsNA and the corresponding 3'-end region of the passenger/sense strand of a dsNA and/or to the duplex region formed by the 3'-end region of the guide/antisense strand of a dsNA and the corresponding 5'-end region of the passenger/sense strand of a dsNA). Thus, formulated RNAi therapies, such as those described herein, are attractive modalities for treating or preventing diseases or disorders that are present in, originate in or otherwise involve the liver.

Methods of Introducing Nucleic Acids, Vectors, and Host Cells dsRNA agents of the invention may be directly introduced into a cell (i.e., intracellularly); or introduced extracellularly into a cavity, interstitial space, into the circulation of an organism, introduced orally, or may be introduced by bathing a cell or organism in a solution containing the nucleic acid. Vascular or extravascular circulation, the blood or lymph system, and the cerebrospinal fluid are sites where the nucleic acid may be introduced.

The dsRNA agents of the invention can be introduced using nucleic acid delivery methods known in art including injection of a solution containing the nucleic acid, bombardment by particles covered by the nucleic acid, soaking the cell or organism in a solution of the nucleic acid, or electroporation of cell membranes in the presence of the nucleic acid. Other methods known in the art for introducing nucleic acids to cells may be used, such as lipid-mediated carrier transport, chemical-mediated transport, and cationic liposome transfection such as calcium phosphate, and the like. The nucleic acid may be introduced along with other components that perform one or more of the following activities: enhance nucleic acid uptake by the cell or otherwise increase inhibition of the target transthyretin RNA.

A cell having a target transthyretin RNA may be from the germ line or somatic, totipotent or pluripotent, dividing or non-dividing, parenchyma or epithelium, immortalized or transformed, or the like. The cell may be a stem cell or a differentiated cell. Cell types that are differentiated include adipocytes, fibroblasts, myocytes, cardiomyocytes, endothelium, neurons, glia, blood cells, megakaryocytes, lymphocytes, macrophages, neutrophils, eosinophils, basophils, mast cells, leukocytes, granulocytes, keratinocytes, chondrocytes, osteoblasts, osteoclasts, hepatocytes, and cells of the endocrine or exocrine glands.

Depending on the particular target transthyretin RNA sequence and the dose of dsRNA agent material delivered, this process may provide partial or complete loss of function for the transthyretin RNA. A reduction or loss of RNA levels or expression (either transthyretin RNA expression or encoded polypeptide expression) in at least 50%, 60%, 70%, 80%, 90%, 95% or 99% or more of targeted cells is exemplary. Inhibition of transthyretin RNA levels or expression refers to the absence (or observable decrease) in the level of transthyretin RNA or transthyretin RNA-encoded protein. Specificity refers to the ability to inhibit the transthyretin RNA without manifest effects on other genes of the cell. The consequences of inhibition can be confirmed by examination of the outward properties of the cell or organism or by biochemical techniques such as RNA solution hybridization, nuclease protection, Northern hybridization, reverse transcription, gene expression monitoring with a microarray, antibody binding, enzyme linked immunosorbent assay (ELISA), Western blotting, radioimmunoassay (RIA), other immunoassays, and fluorescence activated cell analysis (FACS). Inhibition of target transthyretin RNA sequence(s) by the dsRNA agents of the invention also can be measured based upon the effect of administration of such dsRNA agents upon development/progression of a transthyretin-associated disease or disorder, e.g., tumor formation, growth, metastasis, etc., either in vivo or in vitro. Treatment and/or reductions in tumor or cancer cell levels can include halting or reduction of growth of tumor or cancer cell levels or reductions of, e.g., 10%, 20%, 30%, 40%, 50%, 60%, 70%, 80%, 90%, 95% or 99% or more, and can also be measured in logarithmic terms, e.g., 10-fold, 100-fold, 1000-fold, $10^5$-fold, $10^6$-fold, $10^7$-fold reduction in cancer cell levels could be achieved via administration of the dsRNA agents of the invention to cells, a tissue, or a subject.

For RNA-mediated inhibition in a cell line or whole organism, expression a reporter or drug resistance gene whose protein product is easily assayed can be measured. Such reporter genes include acetohydroxyacid synthase (AHAS), alkaline phosphatase (AP), beta galactosidase (LacZ), beta glucoronidase (GUS), chloramphenicol acetyltransferase (CAT), green fluorescent protein (GFP), horseradish peroxidase (HRP), luciferase (Luc), nopaline synthase (NOS), octopine synthase (OCS), and derivatives thereof. Multiple selectable markers are available that confer resistance to ampicillin, bleomycin, chloramphenicol, gentamycin, hygromycin, kanamycin, lincomycin, methotrexate, phosphinothricin, puromycin, and tetracyclin. Depending on the assay, quantitation of the amount of gene expression allows one to determine a degree of inhibition which is greater than 10%, 33%, 50%, 90%, 95% or 99% as compared to a cell not treated according to the present invention.

Lower doses of injected material and longer times after administration of RNA silencing agent may result in inhibition in a smaller fraction of cells (e.g., at least 10%, 20%, 50%, 75%, 90%, or 95% of targeted cells). Quantitation of gene expression in a cell may show similar amounts of inhibition at the level of accumulation of target transthyretin RNA or translation of target protein. As an example, the efficiency of inhibition may be determined by assessing the amount of gene product in the cell; RNA may be detected with a hybridization probe having a nucleotide sequence outside the region used for the inhibitory dsRNA, or translated polypeptide may be detected with an antibody raised against the polypeptide sequence of that region.

The dsRNA agent may be introduced in an amount which allows delivery of at least one copy per cell. Higher doses (e.g., at least 5, 10, 100, 500 or 1000 copies per cell) of material may yield more effective inhibition; lower doses may also be useful for specific applications.

Transthyretin Biology

Transthyretin (TTR) is a secreted thyroid hormone-binding protein. TTR binds and transports retinol binding protein (RBP)/Vitamin A, and serum thyroxine (T4) in plasma and cerebrospinal fluid.

In cerebrospinal fluid, TTR is the primary carrier of T4. TTR also acts as a carrier of retinol (vitamin A) through its association with retinol-binding protein (RBP) in the blood and the CSF. Less than 1% of TTR's T4 binding sites are occupied in blood, which helps to prevent TTR's dissociation, misfolding and aggregation, which can provoke degeneration of post-mitotic tissue.

Numerous other small molecules are known to bind in the thyroxine binding sites, including many natural products (such as resveratrol), drugs (Tafamidis (Razavi et al. Angew. Chem. Int. Ed. Engl. 42 (24): 2758-61), or Vyndaqel, diflunisal (Sekijima et al. Amyloid 13 (4): 236-49; Adamski-Werner et al. J. Med. Chem. 47 (2): 355-74; Vilaro et al. XIth International Symposium on Amyloidosis. Boca Raton: CRC), flufenamic acid (Baures et al. Bioorg. Med. Chem. 7 (7): 1339-47)), and toxins (PCB (Purkey et al. Chem. Biol. 11 (12): 1719-28)).

TTR is a 55 kDa homotetramer with a dimer of dimers quaternary structure that is synthesized in the liver, choroid plexus and retinal pigment epithelium for secretion into the bloodstream, cerebrospinal fluid and the eye, respectively. Each monomer is a 127-residue polypeptide rich in beta sheet structure. Association of two monomers via their edge beta-strands forms an extended beta sandwich. Further association of two of these dimers in a face-to-face fashion produces the homotetrameric structure and creates the two thyroxine binding sites per tetramer. This dimer-dimer interface, comprising the two T4 binding sites, is the weaker dimer-dimer interface and is the one that comes apart first in the process of tetramer dissociation (Foss et al. Biochemistry 44: 15525-33).

Because TTR is primarily produced in the liver, replacement of a liver containing a mutant TTR gene with a normal gene is able to reduce the mutant TTR levels in the body to <5% of pretransplant levels. Certain mutations, however, cause CNS amyloidosis, and due to the their production by the choroid plexus, the CNS TTR amyloid diseases do not respond to gene therapy mediated by liver transplantation. In 2011, the European Medicines Agency approved Tafamidis or Vyndagel (Razavi et al. Angew. Chem. Int. Ed. Engl. 42 (24): 2758-61) for the amelioration of FAP. Vyndagel kinetically stabilizes the TTR tetramer, preventing tetramer dissociation required for TTR amyloidogenesis and degradation of the autonomic nervous system (Ando and Suhr.

Amyloid 5: 288-300) and/or the peripheral nervous system and/or the heart (Hammarström et al. Science 299: 713-6).

TTR is also thought to have beneficial side, as it binds beta-amyloid protein, thereby preventing beta-amyloid accumulation into plaques associated with the early stages of Alzheimer's Disease. Preventing plaque formation is believed to enable a cell to rid itself of this otherwise toxic protein form and, thus, help prevent and maybe even treat the disease (Li and Buxbaum. Molecular Neurodegeneration 6: 79).

There is now strong genetic (Coelho et al. J Rheumatol 20, 179; Hammarström et al. Science 293: 2459-62) and pharmacologic data indicating that the process of amyloid fibril formation leads to the degeneration of post-mitotic tissue causing FAP and likely FAC and SSA. Evidence points to the oligomers generated in the process of amyloidogenicity leading to the observed proteotoxicity (Sousa et al. Am. J. Pathol. 159: 1993-2000; Reixach et al. Proc. Natl. Acad. Sci. U.S.A. 101: 2817-22).

Transthyretin level in cerebrospinal fluid has also been found to be lower in patients with some neurobiological disorders such as schizophrenia (Huang et al. PLoS Med. 3: e428). The reduced level of transthyretin in the CSF may indicate a lower thyroxine transport in brains of patients with schizophrenia.

Because transthyretin is made in part by the choroid plexus, it can also be used as an immunohistochemical marker for choroid plexus papillomas.

In medicine, nutritional status can be assessed by measuring the concentration of transthyretin in the blood. In theory, other transport proteins such as albumin or transferrin could be used, but transthyretin is preferred because of its shorter half-life, although this means that its concentration more closely reflects recent dietary intake rather than overall nutritional status (Shenkin, Alan Clin Chem 52: 2177-2179). Transthyretin concentration has been shown to be a good indicator of whether or not a malnourished patient will develop refeeding syndrome upon commencement of refeeding, via either the enteral, parenteral or oral routes (Marik and Bedigian. Arch Surg 131 (10): 1043-1047).

Transthyretin has been shown to interact with Perlecan (Smeland et al. Biochem. J. (England) 326: 829-36).

Pharmaceutical Compositions

In certain embodiments, the present invention provides for a pharmaceutical composition comprising the dsRNA agent of the present invention. The dsRNA agent sample can be suitably formulated and introduced into the environment of the cell by any means that allows for a sufficient portion of the sample to enter the cell to induce gene silencing, if it is to occur. Many formulations for dsRNA are known in the art and can be used so long as the dsRNA gains entry to the target cells so that it can act. See, e.g., U.S. published patent application Nos. 2004/0203145 A1 and 2005/0054598 A1. For example, the dsRNA agent of the instant invention can be formulated in buffer solutions such as phosphate buffered saline solutions, liposomes, micellar structures, and capsids. Formulations of dsRNA agent with cationic lipids can be used to facilitate transfection of the dsRNA agent into cells. For example, cationic lipids, such as lipofectin (U.S. Pat. No. 5,705,188), cationic glycerol derivatives, and polycationic molecules, such as polylysine (published PCT International Application WO 97/30731), can be used. Suitable lipids include Oligofectamine, Lipofectamine (Life Technologies), NC388 (Ribozyme Pharmaceuticals, Inc., Boulder, Colo.), or FuGene 6 (Roche) all of which can be used according to the manufacturer's instructions.

Such compositions typically include the nucleic acid molecule and a pharmaceutically acceptable carrier. As used herein the language "pharmaceutically acceptable carrier" includes saline, solvents, dispersion media, coatings, antibacterial and antifungal agents, isotonic and absorption delaying agents, and the like, compatible with pharmaceutical administration. Supplementary active compounds can also be incorporated into the compositions.

A pharmaceutical composition is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in a selected solvent with one or a combination of ingredients enumerated above, as required, followed by filtered sterilization. Generally, dispersions are prepared by incorporating the active compound into a sterile vehicle, which contains a basic dispersion medium and the required other ingredients from those enumerated above. In the case of sterile powders for the preparation of sterile injectable solutions, the preferred methods of preparation are vacuum drying and freezedrying which yields a powder of the active ingredient plus any additional desired ingredient from a previously sterile-filtered solution thereof.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer. Such methods include those described in U.S. Pat. No. 6,468,798.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

The compounds can also be administered by transfection or infection using methods known in the art, including but not limited to the methods described in McCaffrey et al. (2002), Nature, 418(6893), 38-9 (hydrodynamic transfection); Xia et al. (2002), Nature Biotechnol., 20(10), 1006-10 (viral-mediated delivery); or Putnam (1996), Am. J. Health Syst. Pharm. 53(2), 151-160, erratum at Am. J. Health Syst. Pharm. 53(3), 325 (1996).

The compounds can also be administered by a method suitable for administration of nucleic acid agents, such as a DNA vaccine. These methods include gene guns, bio injectors, and skin patches as well as needle-free methods such as the micro-particle DNA vaccine technology disclosed in U.S. Pat. No. 6,194,389, and the mammalian transdermal needle-free vaccination with powder-form vaccine as disclosed in U.S. Pat. No. 6,168,587. Additionally, intranasal delivery is possible, as described in, inter alia, Hamajima et al. (1998), Clin. Immunol. Immunopathol., 88(2), 205-10. Liposomes (e.g., as described in U.S. Pat. No. 6,472,375) and microencapsulation can also be used. Biodegradable targetable microparticle delivery systems can also be used (e.g., as described in U.S. Pat. No. 6,471,996).

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Such formulations can be prepared using standard techniques. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds which exhibit high therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the $ED_{50}$ with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range that includes the $IC_{50}$ (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

As defined herein, a therapeutically effective amount of a nucleic acid molecule (i.e., an effective dosage) depends on the nucleic acid selected. For instance, single dose amounts of a dsRNA (or, e.g., a construct(s) encoding for such dsRNA) in the range of approximately 1 pg to 1000 mg may be administered; in some embodiments, 10, 30, 100, or 1000 pg, or 10, 30, 100, or 1000 ng, or 10, 30, 100, or 1000 µg, or 10, 30, 100, or 1000 mg may be administered. In some embodiments, 1-5 g of the compositions can be administered. The compositions can be administered one from one or more times per day to one or more times per week; including once every other day. The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a nucleic acid (e.g., dsRNA), protein, polypeptide, or antibody can include a single treatment or, preferably, can include a series of treatments.

The nucleic acid molecules of the invention can be inserted into expression constructs, e.g., viral vectors, retroviral vectors, expression cassettes, or plasmid viral vectors, e.g., using methods known in the art, including but not limited to those described in Xia et al., (2002), supra.

Expression constructs can be delivered to a subject by, for example, inhalation, orally, intravenous injection, local administration (see U.S. Pat. No. 5,328,470) or by stereotactic injection (see e.g., Chen et al. (1994), Proc. Natl. Acad. Sci. USA, 91, 3054-3057). The pharmaceutical preparation of the delivery vector can include the vector in an acceptable diluent, or can comprise a slow release matrix in which the delivery vehicle is imbedded. Alternatively, where the complete delivery vector can be produced intact from recombinant cells, e.g., retroviral vectors, the pharmaceutical preparation can include one or more cells which produce the gene delivery system.

The expression constructs may be constructs suitable for use in the appropriate expression system and include, but are not limited to retroviral vectors, linear expression cassettes, plasmids and viral or virally-derived vectors, as known in the art. Such expression constructs may include one or more inducible promoters, RNA Pol III promoter systems such as U6 snRNA promoters or H1 RNA polymerase III promoters, or other promoters known in the art. The constructs can include one or both strands of the siRNA. Expression constructs expressing both strands can also include loop structures linking both strands, or each strand can be separately transcribed from separate promoters within the same construct. Each strand can also be transcribed from a separate expression construct, e.g., Tuschl (2002, *Nature Biotechnol* 20: 500-505).

It can be appreciated that the method of introducing dsRNA agents into the environment of the cell will depend on the type of cell and the make up of its environment. For example, when the cells are found within a liquid, one preferable formulation is with a lipid formulation such as in lipofectamine and the dsRNA agents can be added directly to the liquid environment of the cells. Lipid formulations can also be administered to animals such as by intravenous, intramuscular, or intraperitoneal injection, or orally or by inhalation or other methods as are known in the art. When the formulation is suitable for administration into animals such as mammals and more specifically humans, the formulation is also pharmaceutically acceptable. Pharmaceutically acceptable formulations for administering oligonucleotides are known and can be used. In some instances, it may be preferable to formulate dsRNA agents in a buffer or saline solution and directly inject the formulated dsRNA agents into cells, as in studies with oocytes. The direct injection of dsRNA agent duplexes may also be done. For suitable methods of introducing dsRNA (e.g., DsiRNA agents), see U.S. published patent application No. 2004/0203145 A1.

Suitable amounts of a dsRNA agent must be introduced and these amounts can be empirically determined using standard methods. Typically, effective concentrations of individual dsRNA agent species in the environment of a cell will be 50 nanomolar or less, 10 nanomolar or less, or compositions in which concentrations of 1 nanomolar or less can be used. In another embodiment, methods utilizing a concentration of 200 picomolar or less, 100 picomolar or less, 50 picomolar or less, 20 picomolar or less, and even a concentration of 10 picomolar or less, 5 picomolar or less, 2 picomolar or less or 1 picomolar or less can be used in many circumstances.

The method can be carried out by addition of the dsRNA agent compositions to an extracellular matrix in which cells can live provided that the dsRNA agent composition is formulated so that a sufficient amount of the dsRNA agent can enter the cell to exert its effect. For example, the method is amenable for use with cells present in a liquid such as a liquid culture or cell growth media, in tissue explants, or in whole organisms, including animals, such as mammals and especially humans.

The level or activity of a transthyretin RNA can be determined by a suitable method now known in the art or that is later developed. It can be appreciated that the method used to measure a target RNA and/or the expression of a target RNA can depend upon the nature of the target RNA. For example, where the target transthyretin RNA sequence encodes a protein, the term "expression" can refer to a protein or the transthyretin RNA/transcript derived from the transthyretin gene (either genomic or of exogenous origin). In such instances the expression of the target transthyretin RNA can be determined by measuring the amount of transthyretin RNA/transcript directly or by measuring the amount of transthyretin protein. Protein can be measured in protein assays such as by staining or immunoblotting or, if the protein catalyzes a reaction that can be measured, by measuring reaction rates. All such methods are known in the art and can be used. Where target transthyretin RNA levels are to be measured, art-recognized methods for detecting RNA levels can be used (e.g., RT-PCR, Northern Blotting, etc.). In targeting transthyretin RNAs with the dsRNA agents of the instant invention, it is also anticipated that measurement of the efficacy of a dsRNA agent in reducing levels of transthyretin RNA or protein in a subject, tissue, in cells, either in vitro or in vivo, or in cell extracts can also be used to determine the extent of reduction of transthyretin-associated phenotypes (e.g., disease or disorders, e.g., cancer or tumor formation, growth, metastasis, spread, etc.). The above measurements can be made on cells, cell extracts, tissues, tissue extracts or other suitable source material.

The determination of whether the expression of a transthyretin RNA has been reduced can be by a suitable method that can reliably detect changes in RNA levels. Typically, the determination is made by introducing into the environment of a cell undigested dsRNA such that at least a portion of that dsRNA agent enters the cytoplasm, and then measuring the level of the target RNA. The same measurement is made on identical untreated cells and the results obtained from each measurement are compared.

The dsRNA agent can be formulated as a pharmaceutical composition which comprises a pharmacologically effective amount of a dsRNA agent and pharmaceutically acceptable carrier. A pharmacologically or therapeutically effective amount refers to that amount of a dsRNA agent effective to produce the intended pharmacological, therapeutic or preventive result. The phrases "pharmacologically effective amount" and "therapeutically effective amount" or simply "effective amount" refer to that amount of an RNA effective to produce the intended pharmacological, therapeutic or preventive result. For example, if a given clinical treatment is considered effective when there is at least a 20% reduction in a measurable parameter associated with a disease or disorder, a therapeutically effective amount of a drug for the treatment of that disease or disorder is the amount necessary to effect at least a 20% reduction in that parameter.

Suitably formulated pharmaceutical compositions of this invention can be administered by means known in the art such as by parenteral routes, including intravenous, intramuscular, intraperitoneal, subcutaneous, transdermal, airway (aerosol), rectal, vaginal and topical (including buccal and sublingual) administration. In some embodiments, the pharmaceutical compositions are administered by intravenous or intraparenteral infusion or injection.

In general, a suitable dosage unit of dsRNA will be in the range of 0.001 to 0.25 milligrams per kilogram body weight of the recipient per day, or in the range of 0.01 to 20 micrograms per kilogram body weight per day, or in the range of 0.001 to 5 micrograms per kilogram of body weight per day, or in the range of 1 to 500 nanograms per kilogram of body weight per day, or in the range of 0.01 to 10 micrograms per kilogram body weight per day, or in the range of 0.10 to 5 micrograms per kilogram body weight per day, or in the range of 0.1 to 2.5 micrograms per kilogram body weight per day. A pharmaceutical composition comprising the dsRNA can be administered once daily. However, the therapeutic agent may also be dosed in dosage units containing two, three, four, five, six or more sub-doses administered at appropriate intervals throughout the day. In that case, the dsRNA contained in each sub-dose must be correspondingly smaller in order to achieve the total daily dosage unit. The dosage unit can also be compounded for a single dose over several days, e.g., using a conventional sustained release formulation which provides sustained and consistent release of the dsRNA over a several day period. Sustained release formulations are well known in the art. In this embodiment, the dosage unit contains a corresponding multiple of the daily dose. Regardless of the formulation, the pharmaceutical composition must contain dsRNA in a quantity sufficient to inhibit expression of the target gene in the animal or human being treated. The composition can be compounded in such a way that the sum of the multiple units of dsRNA together contain a sufficient dose.

Data can be obtained from cell culture assays and animal studies to formulate a suitable dosage range for humans. The dosage of compositions of the invention lies within a range of circulating concentrations that include the $ED_{50}$ (as determined by known methods) with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range of the compound that includes the $IC_{50}$ (i.e., the concentration of the test compound which achieves a half-maximal inhibition of symptoms) as determined in cell culture. Such information can be used to more accurately determine useful doses in humans. Levels of dsRNA in plasma may be measured by standard methods, for example, by high performance liquid chromatography.

The pharmaceutical compositions can be included in a kit, container, pack, or dispenser together with instructions for administration.

Methods of Treatment

The present invention provides for both prophylactic and therapeutic methods of treating a subject at risk of (or susceptible to) a disease or disorder caused, in whole or in part, by transthyretin (e.g., misregulation and/or elevation of transthyretin transcript and/or transthyretin protein levels), or treatable via selective targeting of transthyretin.

"Treatment", or "treating" as used herein, is defined as the application or administration of a therapeutic agent (e.g., a dsRNA agent or vector or transgene encoding same) to a patient, or application or administration of a therapeutic agent to an isolated tissue or cell line from a patient, who has the disease or disorder, a symptom of disease or disorder or a predisposition toward a disease or disorder, with the purpose to cure, heal, alleviate, relieve, alter, remedy, ameliorate, improve or affect the disease or disorder, the symptoms of the disease or disorder, or the predisposition toward disease.

In one aspect, the invention provides a method for preventing in a subject, a disease or disorder as described above (including, e.g., prevention of the commencement of transforming events within a subject via inhibition of transthyretin expression), by administering to the subject a therapeutic agent (e.g., a dsRNA agent or vector or transgene encoding same). Subjects at risk for the disease can be identified by, for example, one or a combination of diagnostic or prognostic assays as described herein. Administration of a prophylactic agent can occur prior to the detection of, e.g., cancer in a subject, or the manifestation of symptoms characteristic of the disease or disorder, such that the disease or disorder is prevented or, alternatively, delayed in its progression.

Another aspect of the invention pertains to methods of treating subjects therapeutically, i.e., altering the onset of symptoms of the disease or disorder. These methods can be performed in vitro (e.g., by culturing the cell with the dsRNA agent) or, alternatively, in vivo (e.g., by administering the dsRNA agent to a subject).

With regards to both prophylactic and therapeutic methods of treatment, such treatments may be specifically tailored or modified, based on knowledge obtained from the field of pharmacogenomics. "Pharmacogenomics", as used herein, refers to the application of genomics technologies such as gene sequencing, statistical genetics, and gene expression analysis to drugs in clinical development and on the market. More specifically, the term refers the study of how a patient's genes determine his or her response to a drug (e.g., a patient's "drug response phenotype", or "drug response genotype"). Thus, another aspect of the invention provides methods for tailoring an individual's prophylactic or therapeutic treatment with either the target transthyretin RNA molecules of the present invention or target transthyretin RNA modulators according to that individual's drug response genotype. Pharmacogenomics allows a clinician or physician to target prophylactic or therapeutic treatments to patients who will most benefit from the treatment and to avoid treatment of patients who will experience toxic drug-related side effects.

Therapeutic agents can be tested in a selected animal model. For example, a dsRNA agent (or expression vector or transgene encoding same) as described herein can be used in an animal model to determine the efficacy, toxicity, or side effects of treatment with said agent. Alternatively, an agent (e.g., a therapeutic agent) can be used in an animal model to determine the mechanism of action of such an agent.

Models Useful to Evaluate the Down-Regulation of Transthyretin mRNA Levels and Expression Cell Culture The dsRNA agents of the invention can be tested for cleavage activity in vivo, for example, using the following procedure. The nucleotide sequences within the transthyretin cDNA targeted by the dsRNA agents of the invention are shown in the above transthyretin sequences.

The dsRNA reagents of the invention can be tested in cell culture using Huh7 or other mammalian cells (e.g., human cell lines Hep3B, HepG2, DU145, Calu3, SW480, T84, PL45, etc., and mouse cell lines AML12, Neuro2a, etc.) to determine the extent of transthyretin RNA and transthyretin protein inhibition. In certain embodiments, DsiRNA reagents (e.g., see FIG. 1, and above-recited structures) are selected against the transthyretin target as described herein. Transthyretin RNA inhibition is measured after delivery of these reagents by a suitable transfection agent to, for example, cultured Huh7 cells or other transformed or non-transformed mammalian cells in culture. Relative amounts of target transthyretin RNA are measured versus HPRT1, actin or other appropriate control using real-time PCR monitoring of amplification (e.g., ABI 7700 TAQMAN®). A comparison is made to the activity of oligonucleotide sequences made to unrelated targets or to a randomized DsiRNA control with the same overall length and chemistry, or simply to appropriate vehicle-treated or untreated controls. Primary and secondary lead reagents are chosen for the target and optimization performed.

TAQMAN® (Real-Time PCR Monitoring of Amplification) and Lightcycler Quantification of mRNA Total RNA is prepared from cells following DsiRNA delivery, for example, using Ambion Rnaqueous 4-PCR purification kit for large scale extractions, or Promega SV96 for 96-well assays. For Taqman analysis, dual-labeled probes are synthesized with, for example, the reporter dyes FAM or VIC covalently linked at the 5'-end and the quencher dye TAMRA conjugated to the 3'-end. PCR amplifications are performed on, for example, an ABI PRISM 7700 Sequence detector using 50 uL reactions consisting of 10 uL total RNA, 100 nM forward primer, 100 mM reverse primer, 100 nM probe, 1 xTaqMan PCR reaction buffer (PE-Applied Biosystems), 5.5 mM MgCl2, 100 uM each dATP, dCTP, dGTP and dTTP, 0.2 U RNase Inhibitor (Promega), 0.025 U AmpliTaq Gold (PE-Applied Biosystems) and 0.2 U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of target transthyretin mRNA level is determined relative to standards generated from serially diluted total cellular RNA (300, 100, 30, 10 ng/rxn) and normalizing to, for example, HPRT1 mRNA in either parallel or same tube TaqMan reactions.

Western Blotting

Cellular protein extracts can be prepared using a standard micro preparation technique (for example using RIPA buffer), or preferably, by extracting nuclear proteins by a method such as the NE-PER Nuclear and Cytoplasmic Extraction kit (Thermo-Fisher Scientific). Cellular protein extracts are run on Tris-Glycine polyacrylamide gel and transferred onto membranes. Non-specific binding can be blocked by incubation, for example, with 5% non-fat milk for 1 hour followed by primary antibody for 16 hours at 4° C. Following washes, the secondary antibody is applied, for example (1:10,000 dilution) for 1 hour at room temperature and the signal detected on a VersaDoc imaging system In several cell culture systems, cationic lipids have been shown to enhance the bioavailability of oligonucleotides to cells in culture (Bennet, et al., 1992, Mol. Pharmacology, 41, 1023-1033). In one embodiment, dsRNA molecules of the invention are complexed with cationic lipids for cell culture experiments. dsRNA and cationic lipid mixtures are prepared in serum-free OptimMEM (InVitrogen) immediately prior to addition to the cells. OptiMEM is warmed to room temperature (about 20-25° C.) and cationic lipid is added to the final desired concentration. dsRNA molecules are added to OptiMEM to the desired concentration and the solution is added to the diluted dsRNA and incubated for 15 minutes at room temperature. In dose response experiments, the RNA complex is serially diluted into OptiMEM prior to addition of the cationic lipid.

Animal Models

The efficacy of anti-transthyretin dsRNA agents may be evaluated in an animal model. Animal models of amyloidosis and/or liver diseases, conditions, or disorders as are known in the art can be used for evaluation of the efficacy, potency, toxicity, etc. of anti-transthyretin dsRNAs. Exemplary animals model of transthyretin-induced amyloidosis include transgenic mice that express human TTR Val30Met, which recapitulates the human amyloidosis in a transgenic mouse (the behavior of such models also suggest the employment of doxycycline and TUDCA with anti-transthyretin dsRNAs in treatment of amyloidosis (Cardoso I et al. Journal of Translational Medicine 8:74). Such animal models may be used as a source cells or tissue for assays of the compositions of the invention. Such models can also be used or adapted for use for pre-clinical evaluation of the efficacy of dsRNA compositions of the invention in modulating transthyretin gene expression toward therapeutic use.

Such models and/or wild-type mice can be used in evaluating the efficacy of dsRNA molecules of the invention to inhibit transthyretin levels, expression, development of transthyretin-associated phenotypes, diseases or disorders, etc. These models, wild-type mice and/or other models can similarly be used to evaluate the safety/toxicity and efficacy of dsRNA molecules of the invention in a pre-clinical setting.

Specific examples of animal model systems useful for evaluation of the transthyretin-targeting dsRNAs of the invention include wild-type mice and transgenic TTR Val30Met mutant model mice. In an exemplary in vivo experiment, dsRNAs of the invention are tail vein injected into such mouse models at doses ranging from 1 to 10 mg/kg or, alternatively, repeated doses are administered at single-dose $IC_{50}$ levels, and organ samples (e.g., liver, but may also include prostate, kidney, lung, pancreas, colon, skin, spleen, bone marrow, lymph nodes, mammary fat pad, etc.) are harvested 24 hours after administration of the final dose. Such organs are then evaluated for mouse and/or human transthyretin levels, depending upon the model used. Duration of action can also be examined at, e.g., 1, 4, 7, 14, 21 or more days after final dsRNA administration.

The practice of the present invention employs, unless otherwise indicated, conventional techniques of chemistry, molecular biology, microbiology, recombinant DNA, genetics, immunology, cell biology, cell culture and transgenic biology, which are within the skill of the art. See, e.g., Maniatis et al., 1982, Molecular Cloning (Cold Spring Harbor Laboratory Press, Cold Spring Harbor, N.Y.); Sambrook et al., 1989, Molecular Cloning, 2nd Ed. (Cold Spring Harbor Laboratory Press, Cold Spring Harbor, N.Y.); Sambrook and Russell, 2001, Molecular Cloning, 3rd Ed. (Cold Spring Harbor Laboratory Press, Cold Spring Harbor, N.Y.); Ausubel et al., 1992), Current Protocols in Molecular Biology (John Wiley & Sons, including periodic updates); Glover, 1985, DNA Cloning (IRL Press, Oxford); Anand, 1992; Guthrie and Fink, 1991; Harlow and Lane, 1988, Antibodies, (Cold Spring Harbor Laboratory Press, Cold Spring Harbor, N.Y.); Jakoby and Pastan, 1979; Nucleic Acid Hybridization (B. D. Hames & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds.), Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); Riott, Essential Immunology, 6th Edition, Blackwell Scientific Publications, Oxford, 1988; Hogan et al., Manipulating the Mouse Embryo, (Cold Spring Harbor Laboratory Press, Cold Spring Harbor, N.Y., 1986); Westerfield, M., The zebrafish book. A guide for the laboratory use of zebrafish (*Danio rerio*), (4th Ed., Univ. of Oregon Press, Eugene, 2000).

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

The present invention is described by reference to the following Examples, which are offered by way of illustration and are not intended to limit the invention in any manner. Standard techniques well known in the art or the techniques specifically described below were utilized.

Example 1: Preparation of Double-Stranded RNA Oligonucleotides

Oligonucleotide Synthesis and Purification

DsiRNA molecules were designed to interact with various sites in the RNA message, for example, target sequences within the RNA sequences described herein. In presently exemplified agents, 384 human target transthyretin sequences were selected for evaluation (a selection of the 384 human target transthyretin sites were predicted to be conserved with corresponding sites in the mouse transthyretin transcript sequence). The sequences of one strand of the DsiRNA molecules were complementary to the target transthyretin site sequences described above. The DsiRNA molecules were chemically synthesized using methods described herein. Generally, DsiRNA constructs were synthesized using solid phase oligonucleotide synthesis methods as described for 19-23 mer siRNAs (see for example Usman et al., U.S. Pat. Nos. 5,804,683; 5,831,071; 5,998, 203; 6,117,657; 6,353,098; 6,362,323; 6,437,117; 6,469, 158; Scaringe et al., U.S. Pat. Nos. 6,111,086; 6,008,400; 6,111,086).

Individual RNA strands were synthesized and HPLC purified according to standard methods (Integrated DNA Technologies, Coralville, Iowa). For example, RNA oligonucleotides were synthesized using solid phase phosphoramidite chemistry, deprotected and desalted on NAP-5 columns (Amersham Pharmacia Biotech, Piscataway, N.J.) using standard techniques (Damha and Olgivie, 1993, *Methods Mol Biol* 20: 81-114; Wincott et al., 1995, *Nucleic Acids Res* 23: 2677-84). The oligomers were purified using ion-exchange high performance liquid chromatography (IE-HPLC) on an Amersham Source 15Q column (1.0 cm×25 cm; Amersham Pharmacia Biotech, Piscataway, N.J.) using a 15 min step-linear gradient. The gradient varied from 90:10 Buffers A:B to 52:48 Buffers A:B, where Buffer A was 100 mM Tris pH 8.5 and Buffer B was 100 mM Tris pH 8.5, 1 M NaCl. Samples were monitored at 260 nm and peaks corresponding to the full-length oligonucleotide species were collected, pooled, desalted on NAP-5 columns, and lyophilized.

The purity of each oligomer was determined by capillary electrophoresis (CE) on a Beckman PACE 5000 (Beckman Coulter, Inc., Fullerton, Calif.). The CE capillaries had a 100 inn inner diameter and contained ssDNA 100R Gel (Beckman-Coulter). Typically, about 0.6 nmole of oligonucleotide was injected into a capillary, run in an electric field of 444 V/cm and detected by UV absorbance at 260 nm. Denaturing Tris-Borate-7 M-urea running buffer was purchased from Beckman-Coulter. Oligoribonucleotides were obtained that were at least 90% pure as assessed by CE for use in experiments described below. Compound identity was verified by matrix-assisted laser desorption ionization time-of-flight (MALDI-TOF) mass spectroscopy on a Voyager DE™ Biospectometry Work Station (Applied Biosystems, Foster City, Calif.) following the manufacturer's recommended protocol. Relative molecular masses of all oligomers were obtained, often within 0.2% of expected molecular mass.

Preparation of Duplexes

Single-stranded RNA (ssRNA) oligomers were resuspended, e.g., at 100 μM concentration in duplex buffer consisting of 100 mM potassium acetate, 30 mM HEPES, pH 7.5. Complementary sense and antisense strands were mixed in equal molar amounts to yield a final solution of, e.g., 50 μM duplex. Samples were heated to 100° C. for 5' in RNA buffer (IDT) and allowed to cool to room temperature before use. Double-stranded RNA (dsRNA) oligomers were stored at −20° C. Single-stranded RNA oligomers were stored lyophilized or in nuclease-free water at −80° C.

Nomenclature

For consistency, the following nomenclature has been employed in the instant specification. Names given to duplexes indicate the length of the oligomers and the presence or absence of overhangs. A "25/27" is an asymmetric duplex having a 25 base sense strand and a 27 base antisense strand with a 2-base 3'-overhang. A "27/25" is an asymmetric duplex having a 27 base sense strand and a 25 base antisense strand.

Cell Culture and RNA Transfection

Huh7 cells were obtained and maintained in DMEM (HyClone) supplemented with 10% fetal bovine serum (HyClone) at 37° C. under 5% CO2. For RNA transfections, cells were transfected with DsiRNAs at a final concentration of 1 nM, 0.1 nM or 0.03 nM using Lipofectamine™ RNAiMAX (Invitrogen) and following manufacturer's instructions. Briefly, for 0.1 nM transfections, e.g., of Example 3 below, an aliquot of stock solution of each DsiRNA was mixed with Opti-MEM I (Invitrogen) and Lipofectamine™ RNAiMAX to reach a volume of 150 μL (with 0.3 nM DsiRNA). The resulting 150 μL mix was incubated for 20 min at RT to allow DsiRNA:Lipofectamine™ RNAiMAX complexes to form. Meanwhile, target cells were trypsinized and resuspended in medium. At the end of the 20 min of complexation, 50 uL of the DsiRNA:RNAiMAX mixture was added per well into triplicate wells of 96 well plates. Finally, 100 μL of the cell suspension was added to each well (final volume 150 μL) and plates were placed into the incubator for 24 hours.

Assessment of Transthyretin Inhibition

Transthyretin target gene knockdown was determined by qRT-PCR, with values normalized to HPRT and SFRS9 housekeeping genes, and to transfections with control DsiRNAs and/or mock transfection controls.

RNA Isolation and Analysis

Media was aspirated, and total RNA was extracted using the SV96 kit (Promega). Total RNA was reverse-transcribed using SuperscriptII, Oligo dT, and random hexamers following manufacturer's instructions. Typically, the resulting cDNA was analyzed by qPCR using primers and probes specific for both the transthyretin gene and for the human genes HPRT-1 and SFRS9. An ABI 7700 was used for the amplification reactions. Each sample was tested in triplicate. Relative transthyretin RNA levels were normalized to HPRT1 and SFRS9 RNA levels and compared with RNA levels obtained in transfection control samples.

Example 2: DsiRNA Inhibition of Transthyretin

DsiRNA molecules targeting transthyretin were designed and synthesized as described above and tested in human Huh7 cells (alternatively, HepG2 or other human cells could have been used) for inhibitory efficacy. For transfection, annealed DsiRNAs were mixed with the transfection reagent (Lipofectamine™ RNAiMAX, Invitrogen) and incubated for 20 minutes at room temperature. The Huh7 (human) or AML12 (mouse) cells (alternatively, mouse Hepal-6 or other mouse cells could have been used) were trypsinized, resuspended in media, and added to wells (100 uL per well) to give a final DsiRNA concentration of 1 nM in a volume of 150 Each DsiRNA transfection mixture was added to 3 wells for triplicate DsiRNA treatments. Cells were incubated at 37° C. for 24 hours in the continued presence of the DsiRNA transfection mixture. At 24 hours, RNA was prepared from each well of treated cells. The supernatants with the transfection mixtures were first removed and discarded, then the cells were lysed and RNA was prepared from each well. Target transthyretin RNA levels following treatment were evaluated by qRT-PCR for the transthyretin target gene, with values normalized to those obtained for controls. Triplicate data was averaged and the % error was determined for each treatment. Normalized data were both tabulated and graphed, and the reduction of target mRNA by active DsiRNAs in comparison to controls was determined (see Table 7 below and FIGS. 2A to 2D).

TABLE 7

Transthyretin Inhibitory Efficacy of DsiRNAs Assayed at 1 nM in Human Huh7 and Mouse AML12 Cells

| Duplex Name | Mm Location | Macaque* Location | Human - Huh7 Normalized HPRT/Rpl23; vs NC1, NC5, NC7 | | Mouse - AML12 Normalized HPRT/Rpl23; vs NC1, NC5, NC7 | |
|---|---|---|---|---|---|---|
| | | | Hs 67-196 (FAM) Assay % Remaining | Hs 67-196 (FAM) Assay % Remaining | Mm 340-469 (FAM) Assay % Remaining | Mm 340-469 (FAM) Assay % Remaining |
| TTR-27 | 79 | | 94.1 ± 17.1 | 102.3 ± 3.2 | 30.5 ± 11.8 | 34.1 ± 1.5 |
| TTR-28 | 80 | | 126.7 ± 5 | 97.7 ± 5.1 | 58.6 ± 6.7 | 65.7 ± 6.4 |
| TTR-29 | 81 | | 131.6 ± 3.8 | 104 ± 5.1 | 46.1 ± 4.4 | 55.1 ± 4.2 |
| TTR-30 | 82 | | 111.6 ± 0.9 | 87 ± 2.2 | 100.8 ± 5.7 | 109.9 ± 8.4 |
| TTR-31 | 83 | | 106.8 ± 10.4 | 89.3 ± 3.5 | 68.3 ± 5.4 | 68.5 ± 5.5 |
| TTR-32 | 84 | | 112.6 ± 6.1 | 75.9 ± 5.2 | 70.1 ± 8.3 | 66.4 ± 6.4 |
| TTR-33 | 85 | | 121.4 ± 5.1 | 87.3 ± 4.9 | 102.8 ± 6.8 | 102.8 ± 10.1 |
| TTR-34 | 86 | | 117.7 ± 7.2 | 86.3 ± 1.8 | 82.9 ± 4 | 75.4 ± 3.2 |
| TTR-35 | 87 | | 84.5 ± 8.9 | 100 ± 4.3 | 85.8 ± 3.3 | 89.4 ± 5.8 |
| TTR-36 | 88 | | 121.6 ± 14.8 | 98 ± 4.3 | 108.3 ± 3.6 | 110.9 ± 6.9 |
| TTR-37 | 89 | | 102.4 ± 2 | 80.9 ± 2.4 | 107.3 ± 5.3 | 114.1 ± 2 |
| TTR-38 | 90 | | 102.7 ± 9.6 | 77.5 ± 4.1 | 103.6 ± 4.4 | 112.8 ± 4.2 |
| TTR-39 | 91 | | 103.3 ± 2.8 | 77.9 ± 5.2 | 98 ± 4.4 | 86.6 ± 5.9 |
| TTR-40 | 92 | | 113.8 ± 11.6 | 75.3 ± 4 | 106.4 ± 2 | 106.7 ± 6.3 |
| TTR-41 | 93 | | 91.6 ± 14.4 | 67.3 ± 7 | 104.5 ± 1.9 | 104.5 ± 6.5 |
| TTR-43 | | | 110.9 ± 3.8 | 110.1 ± 2.3 | | |
| TTR-44 | | | 98 ± 2.4 | 101.8 ± 1.1 | | |
| TTR-46 | | | 103 ± 2.8 | 97.1 ± 1.5 | | |
| TTR-47 | | | 92.9 ± 5 | 98.4 ± 5.3 | | |
| TTR-59 | | | 95.2 ± 9.3 | 98.3 ± 6 | | |
| TTR-84 | | | 58.6 ± 2.4 | 100.3 ± 9.1 | | |
| TTR-87 | | | 33.4 ± N/A | 102.7 ± N/A | | |
| TTR-88 | | | 33.4 ± 6.6 | 104.5 ± 4 | | |
| TTR-89 | | | 48.5 ± 7.7 | 96.5 ± 5.8 | | |
| TTR-90 | | | 44.8 ± 5.8 | 106.9 ± 5.3 | | |
| TTR-92 | | | 66.1 ± 11.4 | 103.6 ± 2.8 | | |
| TTR-126 | | | 38.9 ± 18 | 106.1 ± 4.1 | | |
| TTR-127 | | | 29.8 ± 11.5 | 96.9 ± 3 | | |
| TTR-128 | | | 8.9 ± 25.8 | 89.2 ± 5.4 | | |
| TTR-129 | | | 7.5 ± 27.8 | 50.6 ± 10.2 | | |
| TTR-130 | | | 4.8 ± 15.2 | 45 ± 5.2 | | |
| TTR-131 | | | 6.6 ± 20.5 | 30.9 ± 9.9 | | |
| TTR-132 | | | 10.7 ± 11.5 | 21 ± 9 | | |
| TTR-134 | | | 32 ± 11.8 | 32.8 ± 5.8 | | |
| TTR-135 | | | 30.3 ± 13 | 38.6 ± 9.8 | | |
| TTR-150 | | 70 | 7.2 ± 35.1 | 10.4 ± 4.7 | 108.9 ± 3.9 | 106.8 ± 10 |
| TTR-151 | | 71 | 34.6 ± 13.9 | 27 ± 8.3 | 109.8 ± 2 | 106.1 ± 8.6 |
| TTR-152 | | 72 | 0.9 ± 57.3 | 3.5 ± 5.4 | 109.3 ± 7.3 | 136.7 ± 3.7 |
| TTR-153 | | 73 | 0.8 ± 65.4 | 3.9 ± 7.8 | 132.7 ± 7.5 | 119.1 ± 4.2 |
| TTR-154 | | 74 | 7 ± 2.2 | 7.3 ± 5.5 | 114.8 ± 3.3 | 116.7 ± 3.9 |
| TTR-155 | | 75 | 2.1 ± 53.9 | 3.7 ± 3.9 | 106.1 ± 2.5 | 111.2 ± 1.6 |
| TTR-156 | | 76 | 3.1 ± 19.7 | 3.3 ± 5.3 | 105.2 ± 8 | 97.6 ± 11.3 |

TABLE 7-continued

Transthyretin Inhibitory Efficacy of DsiRNAs Assayed
at 1 nM in Human Huh7 and Mouse AML12 Cells

| Duplex Name | Mm Location | Macaque* Location | Human - Huh7 Normalized HPRT/Rpl23; vs NC1, NC5, NC7 | | Mouse - AML12 Normalized HPRT/Rpl23; vs NC1, NC5, NC7 | |
|---|---|---|---|---|---|---|
| | | | Hs 67-196 (FAM) Assay % Remaining | Hs 67-196 (FAM) Assay % Remaining | Mm 340-469 (FAM) Assay % Remaining | Mm 340-469 (FAM) Assay % Remaining |
| TTR-157 | | 77 | 1.7 ± 62 | 5.3 ± 5.1 | | |
| TTR-158 | | 78 | 1.5 ± 73.7 | 3 ± 7.8 | | |
| TTR-159 | | 79 | 1.5 ± 58.5 | 3.9 ± 11.5 | | |
| TTR-160 | | 80 | 2.2 ± 20.1 | 4.3 ± 7.9 | | |
| TTR-161 | | 81 | 1.6 ± 50.6 | 5.3 ± 7 | | |
| TTR-162 | | 82 | 5.9 ± 48.7 | 14.2 ± 5.2 | | |
| TTR-163 | | 83 | 55.4 ± 11 | 63.5 ± 8.4 | | |
| TTR-164 | | 84 | 0.8 ± 52.1 | 7.3 ± 5 | | |
| TTR-165 | | 85 | 9.3 ± 28 | 20.3 ± 3.6 | | |
| TTR-186 | | | 15 ± 16.4 | 15.4 ± 8.3 | | |
| TTR-187 | | | 8.9 ± 32.8 | 9.6 ± 11.5 | | |
| TTR-234 | | | 8.3 ± 11.9 | 5.3 ± 1.4 | | |
| TTR-238 | | 158 | 4.3 ± 50.7 | 2.8 ± 9.7 | | |
| TTR-239 | | 159 | 2.8 ± 100 | 6.5 ± 11.9 | | |
| TTR-240 | | 160 | 0.7 ± 100 | 3.1 ± 2.1 | | |
| TTR-241 | | 161 | 15.8 ± 29.3 | 8.1 ± 10.3 | | |
| TTR-242 | | 162 | 1.9 ± 100 | 1.4 ± 5 | | |
| TTR-243 | | 163 | 9 ± 38.9 | 7.1 ± 6.8 | | |
| TTR-244 | | 164 | 3.6 ± 100 | 2.2 ± 4.8 | | |
| TTR-245 | | 165 | 0.3 ± 100 | 1.7 ± 7.6 | | |
| TTR-246 | | 166 | 2 ± 72.4 | 4.7 ± 6.4 | | |
| TTR-247 | | 167 | 21.9 ± 10.8 | 9.8 ± 5.7 | | |
| TTR-248 | 301 | | 4.7 ± 7.3 | 3.6 ± 5.8 | 118.7 ± 2.1 | 107.2 ± 3.7 |
| TTR-249 | 302 | | 2.3 ± 19.4 | 2.9 ± 13.3 | 107 ± 6.2 | 123.9 ± 20.3 |
| TTR-250 | | 170 | 7.3 ± 41.1 | 3.4 ± 6.5 | | |
| TTR-251 | | 171 | 16.3 ± 21.5 | 15.4 ± 5.4 | | |
| TTR-252 | | 172 | 0 ± N/A | 2.6 ± 2.5 | | |
| TTR-253 | | 173 | 17.2 ± 35.1 | 11.6 ± 8.2 | | |
| TTR-254 | | 174 | 3.6 ± 55.1 | 7.5 ± 5.7 | | |
| TTR-255 | | 175 | 1.5 ± 42.2 | 2.5 ± 10.3 | | |
| TTR-256 | | 176 | 7.7 ± 51.3 | 9.1 ± 7 | | |
| TTR-257 | | 177 | 0.6 ± 100 | 2.2 ± 3.1 | | |
| TTR-258 | | 178 | 2.8 ± 79.2 | 4.5 ± 20.1 | | |
| TTR-346 | | 266 | 4.3 ± 31 | 6.7 ± 2.1 | | |
| TTR-347 | | 267 | 7.3 ± 23 | 6.5 ± 6.5 | | |
| TTR-348 | | 268 | 80.5 ± 5.9 | 68.6 ± 5.5 | | |
| TTR-349 | | 269 | 33.1 ± 7.6 | 25.4 ± 4.9 | | |
| TTR-350 | | 270 | 30 ± 4.3 | 34 ± 1.8 | | |
| TTR-351 | | 271 | 85.6 ± 12.9 | 84.6 ± 5.9 | | |
| TTR-352 | | 272 | 23.4 ± 14.3 | 21.3 ± 3.2 | | |
| TTR-353 | | 273 | 79.8 ± 6.7 | 82.2 ± 10.4 | | |
| TTR-354 | | 274 | 15.7 ± 20.4 | 9.9 ± 4.7 | | |
| TTR-355 | | 275 | 4.4 ± 70 | 8.4 ± 4.7 | | |
| TTR-356 | | 276 | 13 ± 17.9 | 7.9 ± 2.6 | | |
| TTR-357 | | 277 | 3.9 ± 44.2 | 3.8 ± 3.4 | | |
| TTR-358 | | 278 | 4.8 ± 29.8 | 8.1 ± 5.7 | | |
| TTR-359 | | 279 | 47.2 ± 4.7 | 48.5 ± 5.6 | | |
| TTR-360 | | 280 | 11.4 ± 10.4 | 8.3 ± 1 | | |
| TTR-361 | | 281 | 20 ± 5.7 | 20.2 ± 4.8 | | |
| TTR-381 | | 301 | 19 ± 15.8 | 27.8 ± 5.5 | | |
| TTR-382 | | 302 | 68 ± 13.7 | 55.1 ± 2.5 | | |
| TTR-383 | | 303 | 3.4 ± 67.8 | 4.4 ± 2.9 | | |
| TTR-384 | | 304 | 24.8 ± 25.1 | 14.8 ± 2.5 | | |
| TTR-385 | | 305 | 31.6 ± 5.2 | 25.8 ± 3.7 | | |
| TTR-386 | | 306 | 63.7 ± 6.9 | 57.8 ± 4.5 | | |
| TTR-387 | | 307 | 36.8 ± 4.1 | 26.6 ± 15.4 | | |
| TTR-388 | | 308 | 62 ± 7.1 | 55.1 ± 7 | | |
| TTR-389 | | 309 | 60 ± 8.8 | 54.5 ± 7.2 | | |
| TTR-390 | | 310 | 17.8 ± 45.5 | 10.9 ± 23.6 | | |
| TTR-391 | | 311 | 36.4 ± 5.3 | 29.5 ± 7.3 | | |
| TTR-392 | | 312 | 30 ± 20.7 | 18.7 ± 16.7 | | |
| TTR-393 | | 313 | 28.7 ± 6.6 | 22.6 ± 5.7 | | |
| TTR-394 | | 314 | 21.7 ± 3.1 | 18 ± 3.3 | | |
| TTR-395 | | 315 | 49.3 ± 7.5 | 45.4 ± 7.5 | | |
| TTR-396 | | 316 | 11.8 ± 24.9 | 12.5 ± 5.3 | | |
| TTR-398 | | | 35.9 ± 8 | 30.7 ± 6.2 | | |
| TTR-399 | | | 16.8 ± 28.5 | 11.6 ± 12.3 | | |
| TTR-400 | | | 83.3 ± 6.4 | 71.8 ± 8.7 | | |
| TTR-401 | | | 52 ± 27 | 43.9 ± 20.8 | | |

TABLE 7-continued

Transthyretin Inhibitory Efficacy of DsiRNAs Assayed
at 1 nM in Human Huh7 and Mouse AML12 Cells

| Duplex Name | Mm Location | Macaque* Location | Human - Huh7 Normalized HPRT/Rpl23; vs NC1, NC5, NC7 | | Mouse - AML12 Normalized HPRT/Rpl23; vs NC1, NC5, NC7 | |
|---|---|---|---|---|---|---|
| | | | Hs 67-196 (FAM) Assay % Remaining | Hs 67-196 (FAM) Assay % Remaining | Mm 340-469 (FAM) Assay % Remaining | Mm 340-469 (FAM) Assay % Remaining |
| TTR-402 | | | 30.5 ± 29.5 | 29.5 ± 27.5 | | |
| TTR-403 | | | 34.3 ± 29 | 27.7 ± 28.9 | | |
| TTR-404 | | | 31.4 ± 23 | 33.8 ± 19.2 | | |
| TTR-405 | | | 5.6 ± 15 | 6.2 ± 5.6 | | |
| TTR-406 | | | 7 ± 5.9 | 9.6 ± 6.4 | | |
| TTR-407 | | | 13.7 ± 51.2 | 17 ± 10.1 | | |
| TTR-408 | | | 38 ± 22 | 35.1 ± 12.9 | | |
| TTR-409 | | | 21.9 ± 17.9 | 16.9 ± 9.7 | | |
| TTR-410 | | | 31.2 ± 9.6 | 33.2 ± 7.1 | | |
| TTR-411 | | | 61.7 ± 6.1 | 46.8 ± 6.6 | | |
| TTR-412 | | | 42.5 ± 12.4 | 32.9 ± 19.8 | | |
| TTR-413 | | | 36.8 ± 6.8 | 26.1 ± 3.4 | | |
| TTR-414 | | | 35.9 ± 13.8 | 37 ± 3.1 | | |
| TTR-415 | | | 52.1 ± 43.9 | 43.8 ± 46.3 | | |
| TTR-416 | | | 33.1 ± 12.9 | 28.8 ± 11.9 | | |
| TTR-417 | | | 73.3 ± 7.5 | 65 ± 2.6 | | |
| TTR-418 | | | 16 ± 10.4 | 16.6 ± 3.9 | | |
| TTR-419 | | | 90 ± 2.1 | 73.7 ± 3.7 | | |
| TTR-420 | | | 44.5 ± 6.4 | 37 ± 7.4 | | |
| TTR-421 | | | 46 ± 10.8 | 40 ± 5.3 | | |
| TTR-422 | | | 2.6 ± 10.9 | 3.4 ± 13.1 | | |
| TTR-423 | | | 4.4 ± 12.4 | 3.5 ± 7.5 | | |
| TTR-424 | | | 4.4 ± 13.3 | 5.6 ± 10.3 | | |
| TTR-425 | | | 27.7 ± 27.9 | 36.3 ± 21.7 | | |
| TTR-426 | | | 17.7 ± 31.8 | 29.2 ± 19.6 | | |
| TTR-427 | | | 11.2 ± 16.7 | 15.5 ± 18 | | |
| TTR-428 | | | 6.8 ± 38.1 | 6.7 ± 8.8 | | |
| TTR-429 | | | 8.3 ± 23.3 | 6 ± 2.6 | | |
| TTR-430 | | | 4.1 ± 62.2 | 13.4 ± 2 | | |
| TTR-431 | | | 30.1 ± 5.4 | 46.1 ± 2.3 | | |
| TTR-432 | | | 3.6 ± 37.5 | 5.1 ± 2.2 | | |
| TTR-433 | | | 7.7 ± 42.7 | 5 ± 0.8 | | |
| TTR-434 | | | 1.6 ± 66.9 | 2.8 ± 2.5 | | |
| TTR-435 | | | 7.3 ± 47.3 | 3.4 ± 5.9 | | |
| TTR-436 | | | 3.4 ± 26.3 | 5.5 ± 7.7 | | |
| TTR-437 | | | 34 ± 14.5 | 30.9 ± 2.8 | | |
| TTR-439 | | | 2.6 ± 41.1 | 4.7 ± 12.5 | | |
| TTR-440 | | | 9.1 ± 16.8 | 6.6 ± 5.2 | | |
| TTR-462 | | 382 | 46.2 ± 9 | 42.4 ± 9.4 | | |
| TTR-463 | | 383 | 89.4 ± 5 | 70.6 ± 3.5 | | |
| TTR-464 | | 384 | 14.9 ± 14.3 | 11.3 ± 10.4 | | |
| TTR-465 | | 385 | 27.1 ± 12.9 | 20 ± 3.6 | | |
| TTR-466 | | 386 | 17.5 ± 17.5 | 14.3 ± 7.9 | | |
| TTR-467 | | 387 | 80.8 ± 3.9 | 75.9 ± 1.2 | | |
| TTR-468 | | 388 | 83.8 ± 7.1 | 69.6 ± 4.9 | | |
| TTR-469 | | 389 | 95.7 ± 1.6 | 92.1 ± 2.6 | | |
| TTR-470 | | 390 | 27 ± 14.4 | 24.7 ± 8.4 | | |
| TTR-471 | | 391 | 32.7 ± 11.3 | 26.3 ± 5.1 | | |
| TTR-472 | | 392 | 73.9 ± 3.3 | 63 ± 2.5 | | |
| TTR-473 | | 393 | 78 ± 2.7 | 69.4 ± 3.1 | | |
| TTR-474 | | 394 | 49.4 ± 4.7 | 53.6 ± 4.2 | | |
| TTR-482 | | | 6.6 ± 20.6 | 7.2 ± 8.4 | | |
| TTR-483 | | | 1.8 ± 6.7 | 4.4 ± 3.7 | | |
| TTR-484 | | | 0.8 ± 100 | 4.9 ± 6.2 | | |
| TTR-485 | | | 32.1 ± 9.5 | 26.1 ± 3.9 | | |
| TTR-489 | | | 4.1 ± 51.5 | 5.6 ± 14.1 | | |
| TTR-493 | | | 7.9 ± 10.6 | 11.8 ± 6.2 | | |
| TTR-494 | | | 9.6 ± 50.3 | 4.9 ± 10.3 | | |
| TTR-581 | | | 122.5 ± 9.1 | 92.4 ± 2 | | |
| TTR-631 | | | 10.4 ± 81.2 | 3.7 ± 14.9 | | |
| TTR-632 | | | 15.4 ± 16.9 | 2.8 ± 6.6 | | |
| TTR-635 | | | 9 ± 21.6 | 7.2 ± 17.9 | | |
| TTR-636 | | | 11 ± 82.8 | 3.3 ± 19.3 | | |
| TTR-637 | | | 2.3 ± 68.1 | 3.5 ± 4.4 | | |
| TTR-639 | | | 12.3 ± 13.2 | 7.9 ± 1.7 | | |
| TTR-640 | | | 2.5 ± 40.3 | 4.1 ± 4.1 | | |
| TTR-641 | | | 7 ± 57.5 | 3.2 ± 3.7 | | |
| TTR-642 | | | 9.7 ± 17.5 | 6.1 ± 11.2 | | |
| TTR-643 | | | 0.9 ± 100 | 2.1 ± 12.4 | | |

TABLE 7-continued

Transthyretin Inhibitory Efficacy of DsiRNAs Assayed
at 1 nM in Human Huh7 and Mouse AML12 Cells

| Duplex Name | Mm Location | Macaque* Location | Human - Huh7 Normalized HPRT/Rpl23; vs NC1, NC5, NC7 | | Mouse - AML12 Normalized HPRT/Rpl23; vs NC1, NC5, NC7 | |
|---|---|---|---|---|---|---|
| | | | Hs 67-196 (FAM) Assay % Remaining | Hs 67-196 (FAM) Assay % Remaining | Mm 340-469 (FAM) Assay % Remaining | Mm 340-469 (FAM) Assay % Remaining |
| TTR-644 | | | 2.9 ± 66.5 | 4.5 ± 2.7 | | |
| TTR-645 | | | 4.1 ± 63.7 | 1.7 ± 9 | | |
| TTR-646 | | | 2.5 ± 67.4 | 3.6 ± 9.7 | | |
| TTR-647 | | | 7.6 ± 18 | 4.4 ± 6.6 | | |
| TTR-648 | | | 0 ± N/A | 2.3 ± 3 | | |
| TTR-649 | | | 10.8 ± 40.8 | 4.5 ± 4.5 | | |
| TTR-650 | | | 0 ± N/A | 1.5 ± 5 | | |
| TTR-651 | | | 0.9 ± 100 | 1.6 ± 16.1 | | |
| TTR-652 | | | 5.5 ± 35.9 | 4.7 ± 5.7 | | |
| TTR-653 | | | 5 ± 7.8 | 2.5 ± 3.2 | | |
| TTR-654 | | | 3.5 ± 50 | 2.9 ± 1.7 | | |
| TTR-655 | | | 6 ± 47.7 | 4.2 ± 6 | | |
| TTR-656 | | | 2 ± 40.8 | 2.7 ± 8.9 | | |
| TTR-657 | | | 1 ± 100 | 2.1 ± 7.6 | | |
| TTR-658 | | | 8 ± 50.2 | 2.1 ± 2.4 | | |
| TTR-659 | | | 7.3 ± 70.9 | 1.3 ± 6.6 | | |
| TTR-660 | | | 1 ± 50.3 | 2.7 ± 15.5 | | |
| TTR-661 | | | 9.2 ± 66 | 1.2 ± 7.8 | | |
| TTR-662 | | | 4.3 ± 67.4 | 2.5 ± 4.4 | | |
| TTR-663 | | | 19.6 ± 14.3 | 15.5 ± 5.7 | | |
| TTR-664 | | | 3.3 ± 58.2 | 2.5 ± 4.1 | | |
| TTR-665 | | | 6.9 ± 38 | 6.7 ± 8.3 | | |
| TTR-666 | | | 18.6 ± 36.8 | 13.2 ± 5.9 | | |
| TTR-667 | | | 4.9 ± 46.9 | 2.3 ± 5.7 | | |
| TTR-668 | | | 0.7 ± 52.5 | 1.3 ± 22.1 | | |
| TTR-669 | | | 9.3 ± 74.5 | 2.5 ± 14.5 | | |
| TTR-670 | | | 1.8 ± 4.4 | 3.1 ± 12.7 | | |
| TTR-671 | | | 33.7 ± 18.5 | 30 ± 4.2 | | |
| TTR-672 | | | 10.5 ± 42.7 | 12.5 ± 13.2 | | |
| TTR-673 | | | 7.5 ± 82.8 | 2.8 ± 6.6 | | |
| TTR-674 | | | 5.6 ± 34.1 | 5.2 ± 8.6 | | |
| TTR-675 | | | 10.9 ± 6.3 | 5.4 ± 7.5 | | |
| TTR-676 | | | 2.4 ± 85 | 2.3 ± 14.4 | | |
| TTR-677 | | | 10.4 ± 24.1 | 3.6 ± 3.3 | | |
| TTR-678 | | | 5.6 ± 21.8 | 3 ± 2.2 | | |
| TTR-679 | | | 7.7 ± 38.3 | 4.6 ± 2.1 | | |
| TTR-680 | | | 8.7 ± 52.1 | 2.3 ± 19.4 | | |
| TTR-681 | | | 5.4 ± 71.2 | 3.3 ± 14.7 | | |
| TTR-682 | | | 7.4 ± 70.1 | 2.9 ± 14.6 | | |
| TTR-683 | | | 3.7 ± 100 | 1.8 ± 19.8 | | |
| TTR-684 | | | 0.8 ± 50.2 | 2.8 ± 11.6 | | |
| TTR-685 | | | 2.3 ± 100 | 1.6 ± 12.6 | | |
| TTR-686 | | | 2.9 ± 50.2 | 2.5 ± 18.3 | | |
| TTR-687 | | | 11.8 ± 27.8 | 7.2 ± 7.9 | | |
| TTR-688 | | | 3.8 ± 57.5 | 8.3 ± 7.8 | | |
| TTR-689 | | | 14.1 ± 33 | 5.7 ± 14.5 | | |
| TTR-690 | | | 1 ± 57.3 | 1.3 ± 3.6 | | |
| TTR-691 | | | 2.5 ± 50 | 2.5 ± 7.5 | | |
| TTR-692 | | | 2.1 ± 67.6 | 1.9 ± 12.3 | | |
| TTR-693 | | | 3.9 ± 45.3 | 2.3 ± 5.7 | | |
| TTR-694 | | | 6.5 ± 50 | 1.9 ± 7.8 | | |
| TTR-695 | | | 6.7 ± 57.3 | 4.8 ± 10.1 | | |
| TTR-696 | | | 5.8 ± 67 | 4 ± 7.7 | | |
| TTR-697 | | | 9.9 ± 18.5 | 6.2 ± 13.9 | | |
| TTR-698 | | | 5.3 ± 57.3 | 3.5 ± 8.4 | | |
| TTR-699 | | | 11.3 ± 16.6 | 7.8 ± 6.8 | | |
| TTR-702 | | | 2.3 ± 22.4 | 2.9 ± 10.8 | | |
| TTR-704 | | | 6.8 ± 53 | 3 ± 35.4 | | |
| TTR-705 | | | 4.9 ± 55.5 | 4.3 ± 3.5 | | |
| TTR-706 | | | 13.6 ± 28.2 | 5.5 ± 7.2 | | |
| TTR-707 | | | 0 ± N/A | 6 ± 8 | | |
| TTR-708 | | | 1.5 ± 100 | 4.2 ± 6 | | |
| TTR-709 | | | 3.4 ± 100 | 3.4 ± 29.2 | | |
| TTR-710 | | | 4 ± 62.8 | 7.4 ± 22.9 | | |
| TTR-711 | | | 1.4 ± 100 | 2.5 ± 23.9 | | |
| TTR-712 | | | 3 ± 50.5 | 2.1 ± 10.4 | | |
| TTR-713 | | | 5.5 ± 62 | 10.4 ± 11.7 | | |
| TTR-714 | | | 3.1 ± 55.3 | 2.9 ± 13 | | |
| TTR-716 | | | 0 ± N/A | 3.4 ± 10.6 | | |

TABLE 7-continued

Transthyretin Inhibitory Efficacy of DsiRNAs Assayed
at 1 nM in Human Huh7 and Mouse AML12 Cells

| | | | Human - Huh7 Normalized HPRT/Rpl23; vs NC1, NC5, NC7 | | Mouse - AML12 Normalized HPRT/Rpl23; vs NC1, NC5, NC7 | |
|---|---|---|---|---|---|---|
| Duplex Name | Mm Location | Macaque* Location | Hs 67-196 (FAM) Assay % Remaining | Hs 67-196 (FAM) Assay % Remaining | Mm 340-469 (FAM) Assay % Remaining | Mm 340-469 (FAM) Assay % Remaining |
| TTR-717 | | | 5.7 ± 43.2 | 4 ± 9 | | |
| TTR-718 | | | 2 ± 60.8 | 2.7 ± 3.2 | | |
| TTR-719 | | | 0.9 ± 100 | 2.8 ± 6 | | |
| TTR-720 | | | 3.6 ± 54.5 | 2.4 ± 8 | | |
| TTR-721 | | | 4.1 ± 75.5 | 3 ± 6.4 | | |
| TTR-722 | | | 0 ± N/A | 3.7 ± 5.3 | | |
| TTR-723 | | | 3 ± 57.4 | 5.3 ± 7.3 | | |
| TTR-724 | | | 2.7 ± 100 | 12.6 ± 9.4 | | |
| TTR-725 | | | 6.9 ± 53 | 3.2 ± 16.1 | | |
| TTR-726 | | | 1.1 ± 100 | 2.4 ± 14.2 | | |
| TTR-727 | | | 0.3 ± 100 | 2.1 ± 10.5 | | |
| TTR-728 | | | 10.5 ± 9.9 | 7.4 ± 3.5 | | |
| TTR-731 | | | 10.1 ± 31.9 | 7.4 ± 2.8 | | |
| TTR-732 | | | 4.2 ± 100 | 7.5 ± 2.4 | | |
| TTR-733 | | | 13.8 ± 30.9 | 17 ± 3.6 | | |
| TTR-734 | | | 16 ± 26.9 | 20.3 ± 8.7 | | |
| TTR-735 | | | 85 ± 8.3 | 76.9 ± 12.7 | | |
| TTR-736 | | | 78.6 ± 6.4 | 75.4 ± 9.9 | | |
| TTR-738 | | | 89.7 ± 10 | 79.8 ± 9.5 | | |
| TTR-739 | | | 96.2 ± 14 | 96.5 ± 3.7 | | |
| TTR-740 | | | 121.1 ± 17.7 | 84.8 ± 12.7 | | |
| TTR-741 | | | 93.2 ± 7.5 | 98.4 ± 10 | | |
| TTR-742 | | | 97.4 ± 9.6 | 100 ± 3.6 | | |
| TTR-743 | | | 101.1 ± 5.7 | 114.3 ± 6.4 | | |
| TTR-744 | | | 122.9 ± 9.4 | 97.1 ± 1.7 | | |
| TTR-745 | | | 88.1 ± 8 | 74 ± 14.7 | | |
| TTR-746 | | | 77.6 ± 14.1 | 74.5 ± 3 | | |
| TTR-747 | | | 72 ± 10.1 | 79.8 ± 2.8 | | |
| TTR-748 | | | 89.4 ± 9.5 | 72.5 ± 2.9 | | |
| TTR-749 | | | 110.8 ± 12.6 | 90.2 ± 10.3 | | |
| TTR-750 | | | 134.5 ± 5.4 | 112.6 ± 5.3 | | |
| TTR-751 | | | 72.1 ± 16.8 | 96 ± 8.4 | | |
| TTR-752 | | | 104.1 ± 2.8 | 100.6 ± 7 | | |
| TTR-753 | | | 94.1 ± 9.8 | 83.9 ± 10.7 | | |
| TTR-754 | | | 106.6 ± 4 | 82 ± 5.8 | | |
| TTR-755 | | | 85.3 ± 9.4 | 80.9 ± 3.7 | | |
| TTR-756 | | | 92.7 ± 6.7 | 76.5 ± 2.5 | | |
| TTR-757 | | | 109.9 ± 4.8 | 88.3 ± 3.8 | | |
| TTR-758 | | | 129 ± 3.5 | 115.3 ± 4.5 | | |
| TTR-759 | | | 93.2 ± 3 | 110.3 ± 2.9 | | |
| TTR-760 | | | 107.3 ± 2.1 | 103.3 ± 3.3 | | |
| TTR-761 | | | 96.1 ± 3.7 | 96.8 ± 8 | | |
| TTR-762 | | | 95.2 ± 3.7 | 92.1 ± 4.4 | | |
| TTR-763 | | | 83.7 ± 4.6 | 97.2 ± 3.9 | | |
| TTR-764 | | | 101.4 ± 4.7 | 105 ± 3.6 | | |
| TTR-765 | | | 95.3 ± 6.8 | 95.6 ± 9.9 | | |
| TTR-766 | | | 108.6 ± 1.8 | 120.1 ± 1.9 | | |
| TTR-767 | | | 94 ± 3.8 | 104 ± 1.4 | | |
| TTR-768 | | | 102.8 ± 7.4 | 99.6 ± 7 | | |
| TTR-769 | | | 96.9 ± 5.2 | 94.9 ± 7 | | |
| TTR-770 | | | 94.4 ± 5.1 | 90.6 ± 4.3 | | |
| TTR-771 | | | 91.6 ± 3 | 95.1 ± 4.9 | | |
| TTR-772 | | | 100.7 ± 4.1 | 82.8 ± 3.8 | | |
| TTR-773 | | | 93.1 ± 2.4 | 89.4 ± 7.4 | | |
| TTR-775 | | | 102.4 ± 3.2 | 109.1 ± 1.8 | | |
| TTR-780 | | | 93.5 ± 3.1 | 99.5 ± 7.8 | | |
| TTR-781 | | | 103.8 ± 1.8 | 93.6 ± 3 | | |
| TTR-784 | | | 100.9 ± 4.4 | 84.1 ± 6.1 | | |
| TTR-805 | | | 88.3 ± 3.8 | 81.8 ± 6 | | |
| TTR-806 | | | 87.3 ± 6.3 | 86.8 ± 6.8 | | |
| TTR-807 | | | 95.7 ± 2 | 91.4 ± 4.2 | | |
| TTR-808 | | | 87.2 ± 2.5 | 86.3 ± 3 | | |
| TTR-809 | | | 118.6 ± 5 | 126.5 ± 3.4 | | |
| TTR-810 | | | 81.7 ± 7.2 | 110.6 ± 6.4 | | |
| TTR-811 | | | 103.4 ± 4.2 | 102.3 ± 3.6 | | |
| TTR-812 | | | 89.5 ± 4.9 | 94.1 ± 2.6 | | |
| TTR-813 | | | 89.1 ± 8.6 | 99 ± 4.7 | | |
| TTR-814 | | | 83.1 ± 2.9 | 94.7 ± 3 | | |
| TTR-815 | | | 90.9 ± 7.2 | 87.5 ± 8.4 | | |

TABLE 7-continued

Transthyretin Inhibitory Efficacy of DsiRNAs Assayed
at 1 nM in Human Huh7 and Mouse AML12 Cells

| | | | Human - Huh7 Normalized HPRT/Rpl23; vs NC1, NC5, NC7 | | Mouse - AML12 Normalized HPRT/Rpl23; vs NC1, NC5, NC7 | |
|---|---|---|---|---|---|---|
| Duplex Name | Mm Location | Macaque* Location | Hs 67-196 (FAM) Assay % Remaining | Hs 67-196 (FAM) Assay % Remaining | Mm 340-469 (FAM) Assay % Remaining | Mm 340-469 (FAM) Assay % Remaining |
| TTR-816 | | | 94.3 ± 5.1 | 93.5 ± 3.8 | | |
| TTR-817 | | | 94.2 ± 3.8 | 97.4 ± 2.9 | | |
| TTR-818 | | | 86.3 ± 5.7 | 99.2 ± 3.8 | | |
| TTR-819 | | | 79.9 ± 1.2 | 83.1 ± 3.2 | | |
| TTR-821 | | | 86.7 ± 6.3 | 91.4 ± 4 | | |
| TTR-822 | | | 84.3 ± 2.6 | 89.8 ± 1.3 | | |
| TTR-823 | | | 92 ± 3.4 | 91.7 ± 3.8 | | |
| TTR-824 | | | 91.5 ± 2.2 | 94.9 ± 1.8 | | |
| TTR-825 | | | 92.2 ± 6.8 | 94.4 ± 5.8 | | |
| TTR-826 | | | 110.8 ± 4.3 | 109 ± 4.1 | | |
| TTR-827 | | | 73.8 ± 5.4 | 89.3 ± 8.5 | | |
| TTR-828 | | | 99.1 ± 4 | 100.2 ± 3.6 | | |
| TTR-829 | | | 91 ± 3.3 | 91.8 ± 1.3 | | |
| TTR-830 | | | 93.9 ± 14.8 | 97.3 ± 5.5 | | |
| TTR-831 | | | 88.2 ± 3 | 95.6 ± 0.6 | | |
| TTR-832 | | | 90.8 ± 2.9 | 88.9 ± 4.4 | | |
| TTR-833 | | | 92.3 ± 2 | 88.6 ± 2 | | |
| TTR-834 | | | 106.2 ± 2.8 | 106.3 ± 3.4 | | |
| TTR-835 | | | 87.5 ± 4.9 | 102.5 ± 5 | | |
| TTR-869 | | | 84.8 ± 6 | 94.8 ± 6 | | |
| TTR-870 | | | 90.9 ± 2.4 | 86.7 ± 2.4 | | |
| TTR-873 | | | 83.1 ± 3.2 | 91.3 ± 1.8 | | |
| TTR-874 | | | 86.3 ± 7.2 | 91.5 ± 6.1 | | |
| TTR-875 | | | 107.4 ± 6.5 | 101.9 ± 14.3 | | |
| TTR-876 | | | 90.9 ± 4 | 78.2 ± 7.7 | | |
| TTR-877 | | | 88.7 ± 1.9 | 87.7 ± 3.3 | | |
| TTR-878 | | | 92.9 ± 2.3 | 99.5 ± 2.3 | | |
| TTR-879 | | | 89.1 ± 2.8 | 92.3 ± 6.5 | | |
| TTR-880 | | | 89.4 ± 9.5 | 84.2 ± 4.4 | | |
| TTR-881 | | | 93.6 ± 9.5 | 88.8 ± 3 | | |
| TTR-882 | | | 95.8 ± 5 | 88.4 ± 4.6 | | |
| TTR-883 | | | 98.9 ± 6.3 | 79.6 ± 6.1 | | |
| TTR-884 | | | 111.9 ± 4.4 | 87.8 ± 0.6 | | |
| TTR-885 | | | 91.5 ± 13.4 | 88.7 ± 1.9 | | |
| TTR-886 | | | 95.5 ± 16.2 | 101.6 ± 13.9 | | |
| TTR-887 | | | 110.6 ± 7.3 | 110 ± 7.6 | | |
| TTR-888 | | | 97.1 ± 6.2 | 91.7 ± 1.9 | | |
| TTR-889 | | | 99 ± 3.2 | 85.1 ± 3 | | |
| TTR-890 | | | 89.3 ± 9 | 93.3 ± 3.2 | | |
| TTR-891 | | | 89.8 ± 6.3 | 84.8 ± 4.1 | | |
| TTR-892 | | | 93.8 ± 6.4 | 82.2 ± 4 | | |
| TTR-893 | | | 114.2 ± 9.8 | 100.2 ± 3.4 | | |
| TTR-894 | | | 73.7 ± 2.3 | 83.8 ± 2.5 | | |
| TTR-895 | | | 91 ± 4 | 86.4 ± 2.4 | | |
| TTR-896 | | | 91.8 ± 8 | 86.5 ± 3.1 | | |
| TTR-897 | | | 95.5 ± 8.5 | 89.1 ± 3.5 | | |
| TTR-898 | | | 101 ± 3.1 | 97.5 ± 2.6 | | |
| TTR-899 | | | 99.7 ± 3.5 | 89.4 ± 3 | | |
| TTR-900 | | | 88.7 ± 4.1 | 86.4 ± 1.9 | | |
| TTR-901 | | | 91.1 ± 8.1 | 97.4 ± 1.9 | | |
| TTR-902 | | | 72.3 ± 3.6 | 78.7 ± 5.6 | | |
| TTR-903 | | | 102 ± 5.4 | 93.2 ± 2.4 | | |
| TTR-904 | | | 98.7 ± 6 | 87.9 ± 4 | | |
| TTR-905 | | | 90.5 ± 2.9 | 89.7 ± 3.9 | | |
| TTR-906 | | | 95.8 ± 4.1 | 91.8 ± 1.2 | | |
| TTR-908 | | | 101 ± 4.4 | 90.7 ± 2.8 | | |
| TTR-909 | | | 93.9 ± 2.2 | 82.2 ± 1.7 | | |
| TTR-911 | | | 90.2 ± 5.3 | 85.8 ± 1.4 | | |
| TTR-912 | | | 79.1 ± 6.7 | 83.2 ± 3.8 | | |
| TTR-913 | | | 92.2 ± 8.2 | 87.7 ± 1.7 | | |
| TTR-914 | | | 103 ± 6.6 | 95.3 ± 5.6 | | |
| TTR-915 | | | 98.8 ± 8.8 | 86.2 ± 3.5 | | |
| TTR-916 | | | 99.5 ± 7.4 | 95.4 ± 0.7 | | |
| TTR-917 | | | 99.3 ± 9.2 | 92.4 ± 3.5 | | |
| TTR-918 | | | 101.8 ± 6.5 | 93.1 ± 7.8 | | |
| TTR-919 | | | 98.5 ± 5.2 | 89.2 ± 7.1 | | |

**Macaca fascicularis*

Example 3: DsiRNA Inhibition of Transthyretin—Secondary Screen 96 asymmetric DsiRNAs (96 targeting Hs transthyretin, 5 of which also targeted Mm transthyretin) of the above experiment were then examined in a secondary assay ("Phase 2"), with results of such assays presented in histogram form in FIGS. 3A to 3H. Specifically, the 96 asymmetric DsiRNAs selected from those tested above were assessed for inhibition of human transthyretin at 1 nM, 0.1 nM and 0.03 nM in the environment of human Huh7 cells (FIGS. 3A to 3D). These 96 asymmetric DsiRNAs were also assessed for inhibition of mouse transthyretin at 1 nM, 0.1 nM and 0.03 nM in the environment of mouse AML12 cells (FIGS. 3E to 3H). As shown in FIGS. 3A to 3D, most asymmetric DsiRNAs reproducibly exhibited significant human transthyretin inhibitory efficacies at sub-nanomolar concentrations when assayed in the environment of Huh7 cells.

Without being bound by theory, it is noted that when using the RT-qPCR method to measure the amount of mRNA remaining after DsiRNA-mediated mRNA knockdown, the position of the qPCR assay within the mRNA can affect the detection of knockdown. The qPCR assay that is closer to the DsiRNA-directed mRNA cleavage point usually yields a more reliable measurement of mRNA level. For example, if a qPCR assay is located away from the cleavage point, slow degradation of the mRNA fragment resulting from DsiRNA-directed cleavage can yield an artifactual high qPCR signal (a 'false negative' for knockdown). A sign of this is high knockdown detected using a qPCR assay located near the DsiRNA site, and artifactual 'low' knockdown detected with a qPCR assay located away from the DsiRNA site. In this situation, the qPCR assay near the DsiRNA site is used for quantitation. This appeared to have been the case for the 3'-located TTR DsiRNAs, which showed high knockdown using the 3'-located qPCR assay even when the 5'-located qPCR assay recorded no or more modest levels of TTR knockdown.

As shown in FIGS. 3E to 3H, a limited number of asymmetric DsiRNAs were also identified to possess significant mouse transthyretin inhibitory efficacies at sub-nanomolar concentrations when assayed in the environment of mouse AML12 cells.

Example 4: Assessment of Modified Forms of Transthyretin-Targeting DsiRNAs In Vitro Twenty-four transthyretin-targeting DsiRNAs (TTR-156, TTR-157, TTR-158, TTR-187, TTR-240, TTR-241, TTR-242, TTR-243, TTR-244, TTR-245, TTR-249, TTR-252, TTR-255, TTR-257, TTR-357, TTR-657, TTR-661, TTR-754, TTR-755, TTR-756, TTR-758, TTR-895, TTR-897 and TTR-902) were prepared with 2'-O-methyl guide strand modification patterns "M17", "M35", "M48" and "M8" as shown above. For each of these DsiRNA sequences, the passenger strand carried the "M107" 2'-O-methyl modification patter. DsiRNAs possessing each of the four guide strand modification patterns M17, M35, M48 and M8 were assayed for transthyretin inhibition in human Huh7 cells at 1.0 nM, 0.1 nM and 0.03 nM concentrations in the environment of the Huh7 cells. Results of these experiments are presented as histograms in FIGS. 4A-4D. In general, the 24 DsiRNA sequences exhibited a trend towards reduced efficacy of TTR inhibition as the extent of 2'-O-methyl modification of the guide strand increased. However, for many of the DsiRNA sequences examined, a modification pattern could be identified that allowed the DsiRNA to retain significant TTR inhibitory efficacy in vitro. It was also notable that a number of these DsiRNAs (e.g., TTR-156, TTR-158, TTR-255, TTR-657 and TTR-661) exhibited no apparent decline in TTR inhibitory efficacy in even the most highly modified states examined. The "false negative" effect described above for 3'-terminal anti-TTR DsiRNAs was again observed. In conclusion, active modified DsiRNA sequences were identified that possessed modification patterns believed to be capable of stabilizing such DsiRNAs and/or reducing immunogenicity of such DsiRNAs when therapeutically administered to a subject in vivo.

Example 5: Additionally Modified Forms of Transthyretin-Targeting DsiRNAs Reduced Transthyretin In Vitro Nine TTR-targeting DsiRNAs (TTR-156, TTR-158, TTR-240, TTR-242, TTR-244, TTR-245, TTR-255, TTR-257 and TTR-357) were prepared with both 2'-O-methyl passenger strand and guide strand modification patterns. For each of the nine DsiRNA sequences, DsiRNAs possessing passenger strand modification patterns selected from SM250, SM251, SM252, SM107, SM14 and SM24 (referred to as simply "M250", "M251", "M252", "M107", "M14" and "M24" in FIGS. 5A-5D, where the passenger strand modification pattern is the first modification pattern listed, followed by the guide strand modification pattern, e.g., "M250-M17" in FIGS. 5A-5D indicates a duplex possessing passenger strand modification pattern "SM250" and guide strand modification pattern "M17") and guide strand modification patterns selected from M17, M35, M48 and M8 were assayed for TTR inhibition in human Huh7 cells at 1.0 nM, 0.1 nM and 0.03 nM concentrations in the environment of the Huh7 cells. Results of these experiments are presented as histograms in FIGS. 5A-5D. As in Example 4 above, in general, the nine DsiRNA sequences exhibited a trend towards reduced efficacy of TTR inhibition as the extent of 2'-O-methyl modification of both passenger and guide strands increased. However, for each of the DsiRNA sequences examined, a combination of passenger and guide strand modification patterns could be identified that allowed the DsiRNA to retain significant TTR inhibitory efficacy in vitro. Thus, such active modified DsiRNA sequences possessed modification patterns believed to be capable of stabilizing such DsiRNAs and/or reducing immunogenicity of such DsiRNAs when therapeutically administered to a subject in vivo.

Figure 6A:
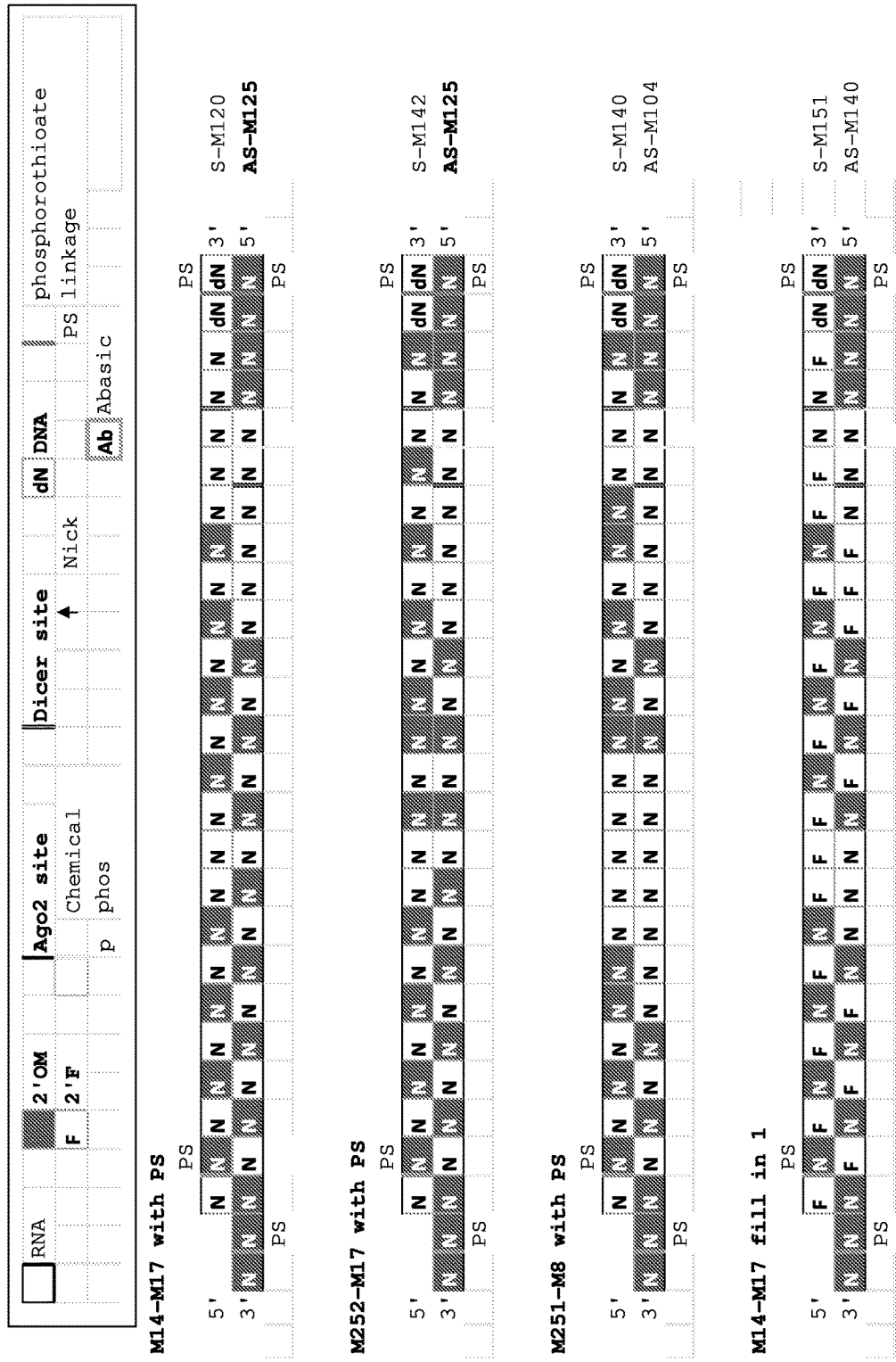
FIGS. 6A to 6D show further modification patterns used in the additional in vitro TTR inhibition experiments of FIGS. 7A to 7E and 8A to 8F.
Figure 6B:
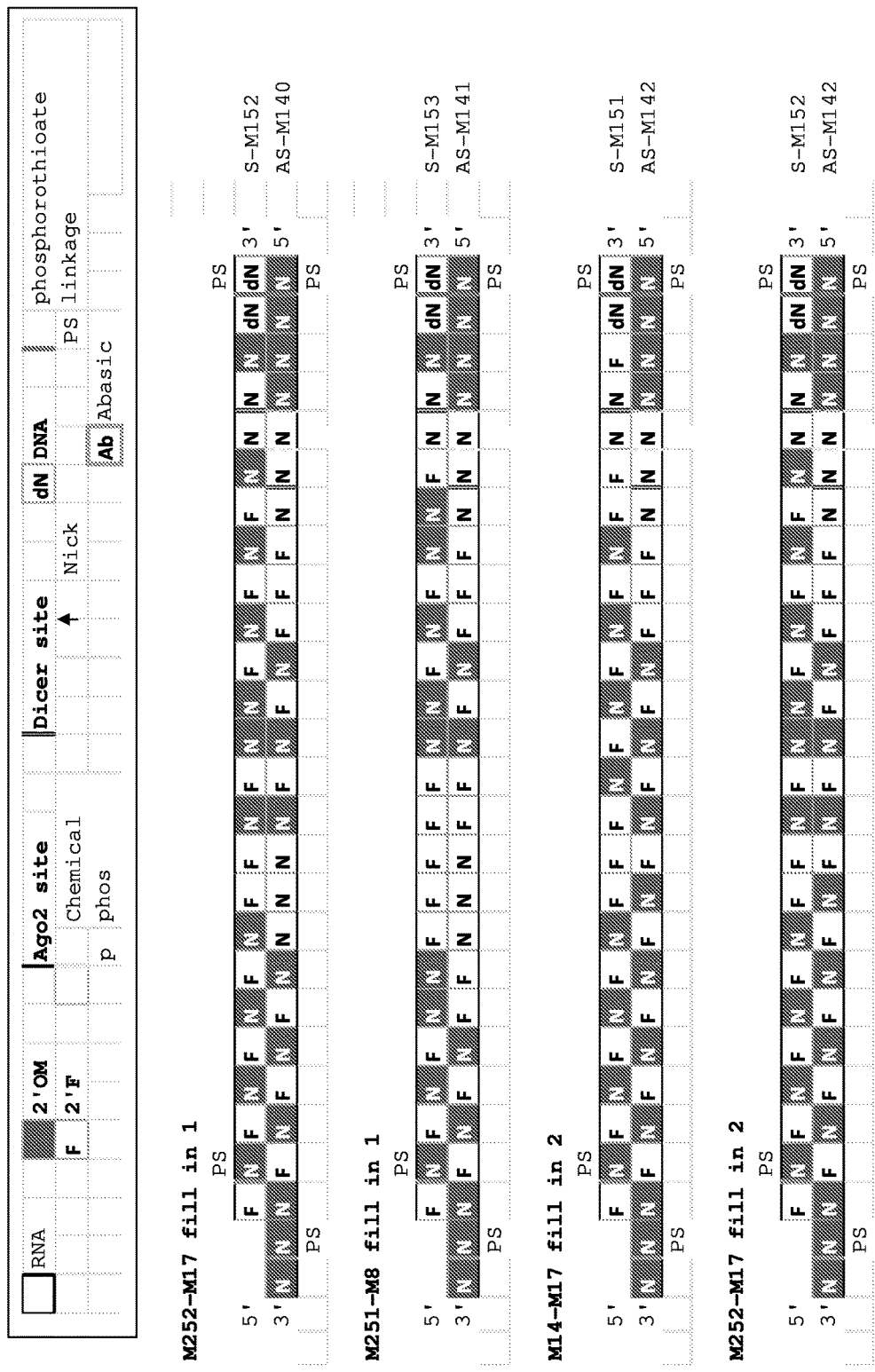
Figure 6C:
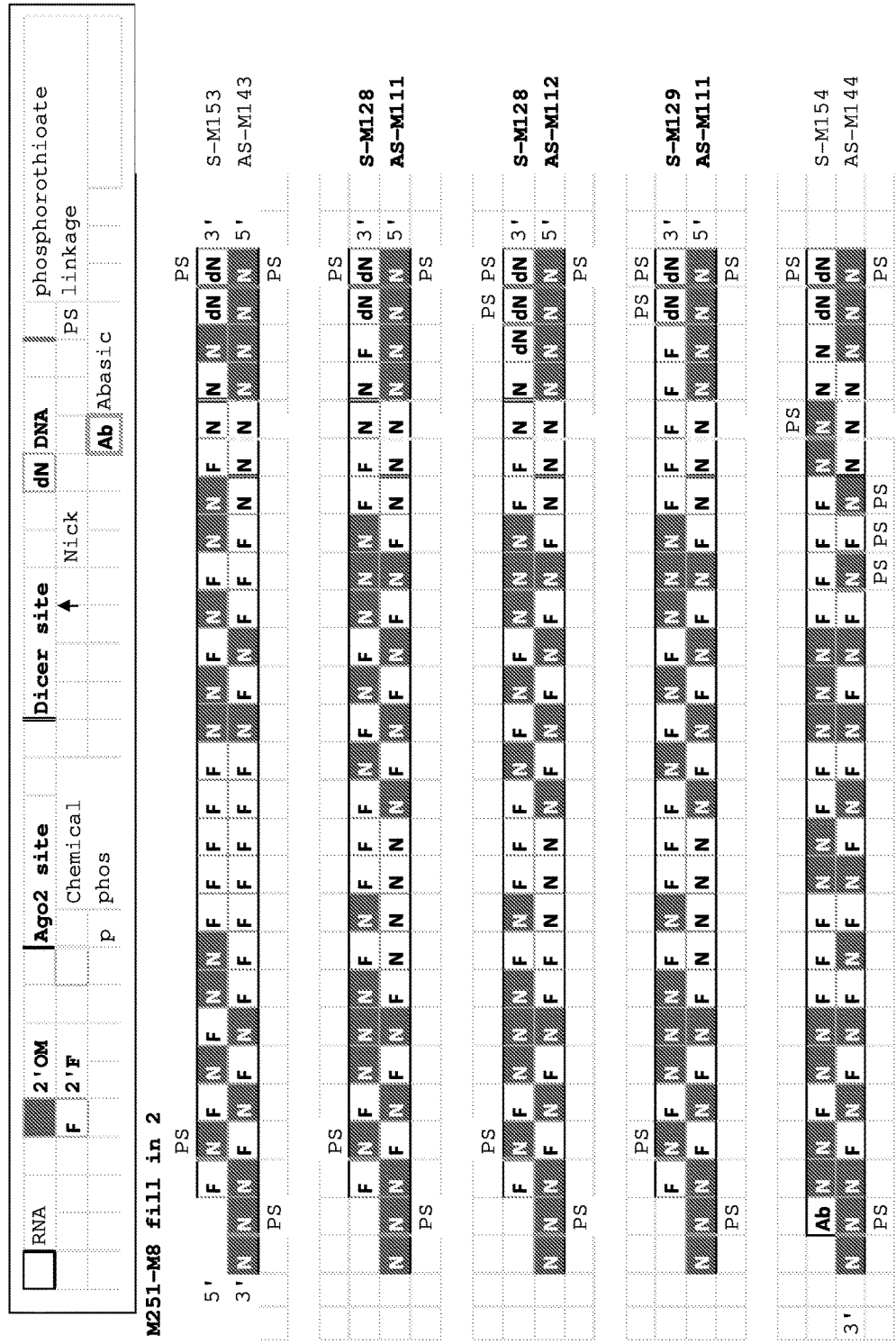
Figure 6D:
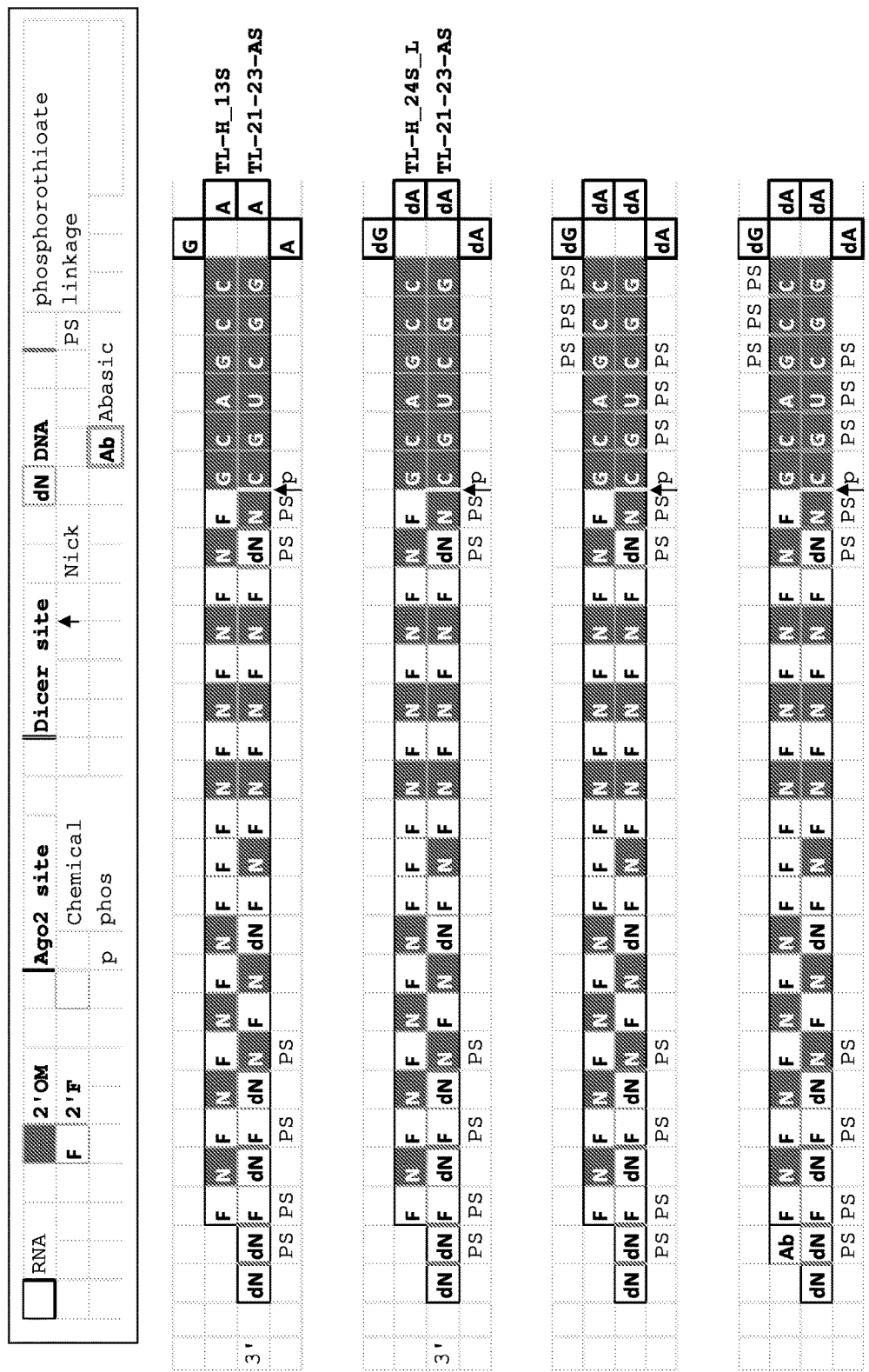

Example 6: Further Modified Forms of Transthyretin-Targeting DsiRNAs Reduced Transthyretin In Vitro Additional modified forms of TTR-targeting DsiRNAs were generated and tested for in vitro efficacy in Huh-7 cells. Modification patterns that were employed for such additional DsiRNA forms are shown in FIGS. 6A to 6D and included 2'-fluoro ("2'-F") "fill in" and tetraloop-containing formats. The fifteen distinct patterns shown in FIGS. 6A to 6D (three forms of dNTP-tetraloop DsiRNA are shown in FIG. 6D, only differing in the location of phosphorothioate (PS) linkages) were applied to four target sequences, TTR-156, TTR-242, TTR-244 and TTR-255. Notably, TTR-156 and TTR-255 were established in the above experiments as being particularly tolerant of heavy 2'-O-methyl modifications. Certain modification patterns constituted parental sequences with phosphorothioate addition, while others were 2'-F "fill ins" that either left Dicer and Antisense Strand (AS) Ago2 sites unmodified or were 2'-F "fill ins" that left the Dicer site unmodified. Finally, there were "stamped on patterns" and tetraloop patterns, as show in FIGS. 6C and 6D.

As demonstrated in FIGS. 7A to 7E, significant TTR knockdown activity was observed for several highly modified forms of each TTR-targeting agent examined. Remarkably, tetraloop formats (either when comprised of DNA or RNA residues) of such TTR-targeting agents exhibited robust levels of TTR knockdown activity. Thus, tetraloop and other loop-containing formats of the dsNAs of the invention are explicitly contemplated, with exemplary tetraloop (including nicked tetraloop) structures set forth in WO 2010/033225.

Figure 8A:
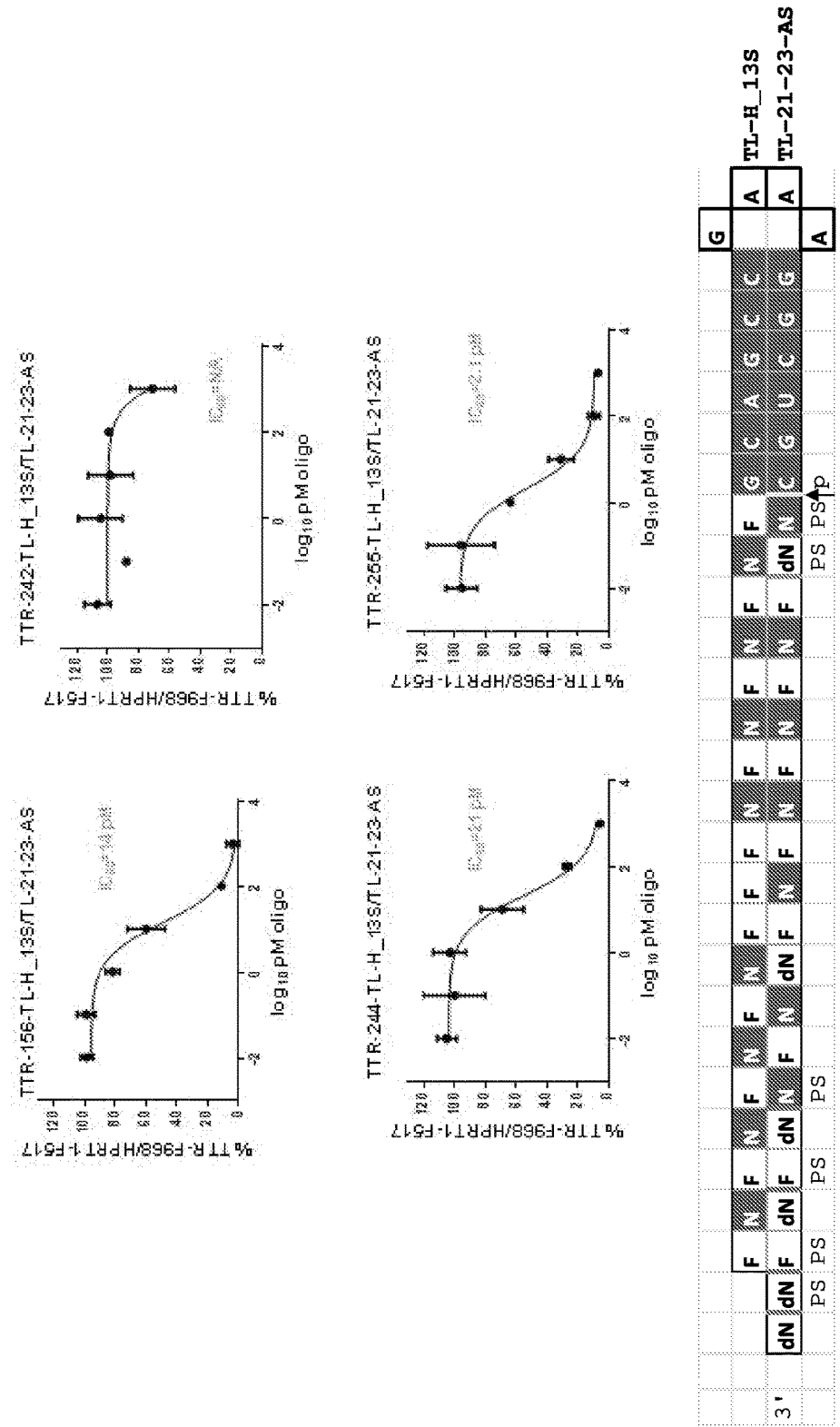
FIGS. 8A to 8F show in vitro TTR inhibitory activity dose-response curves for the further modified forms of TTR-156, TTR-242, TTR-244 and TTR-255 dsRNAs indicated within the figures.
Figure 8B:
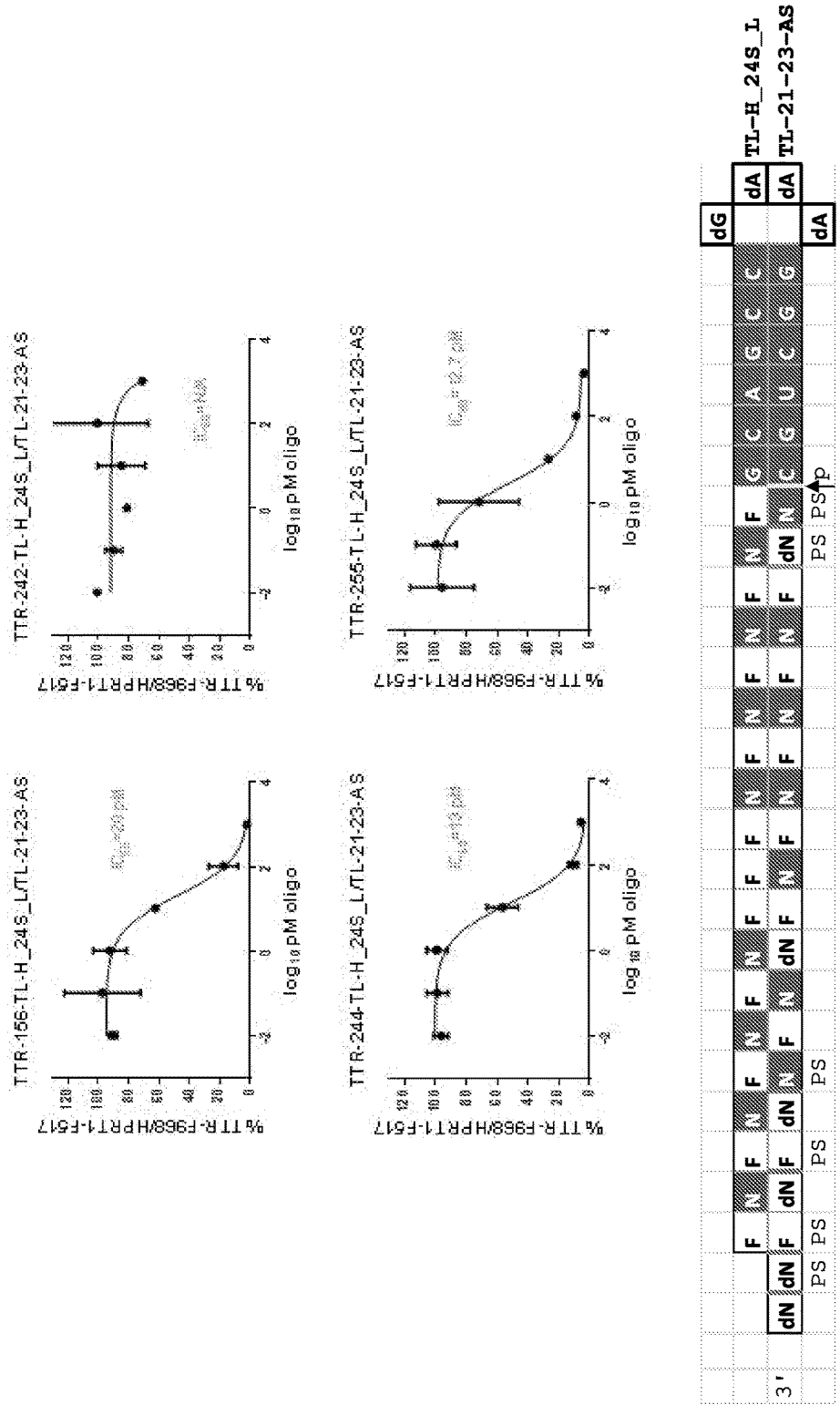
Figure 8C:
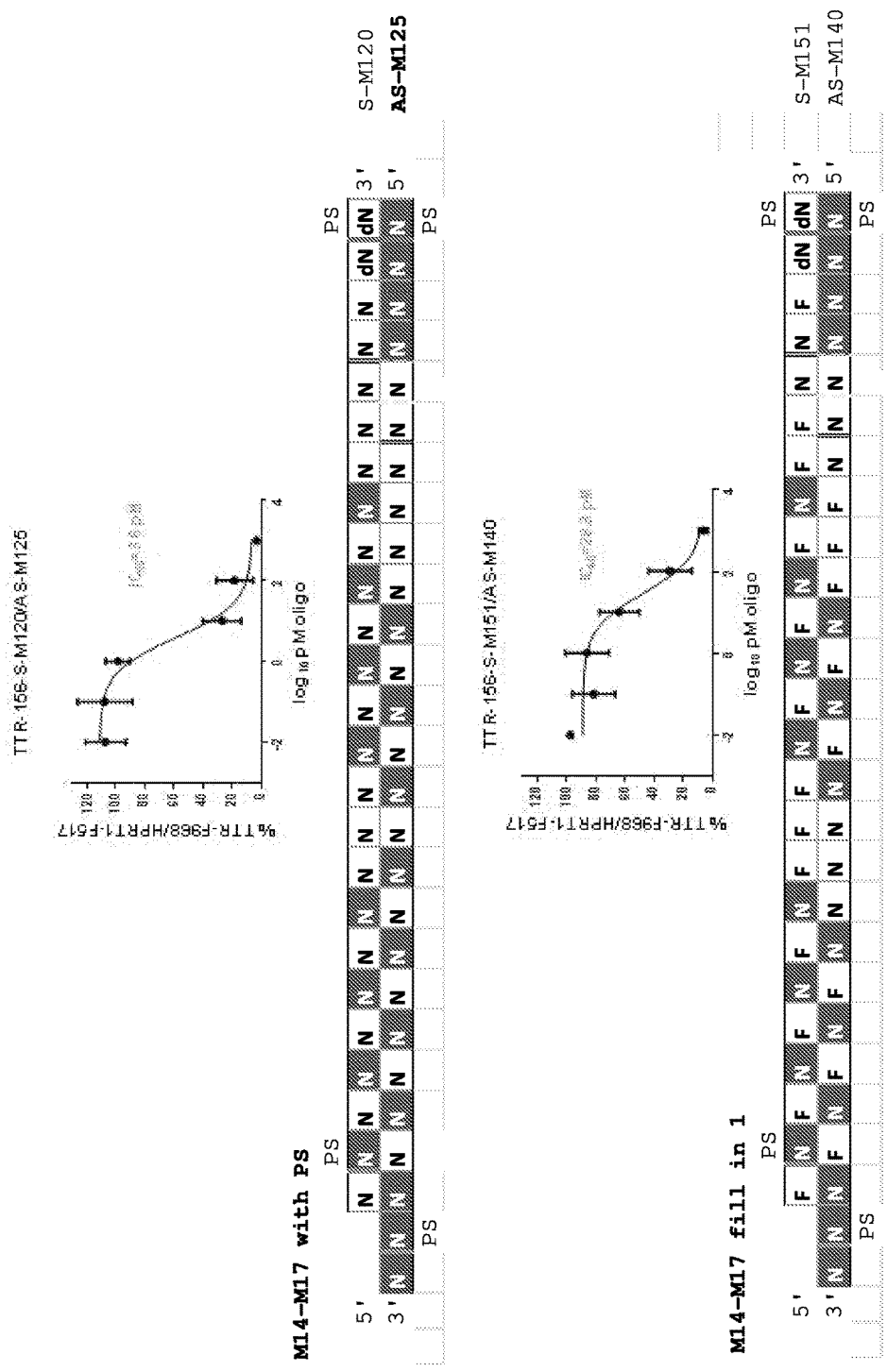
Figure 8D:
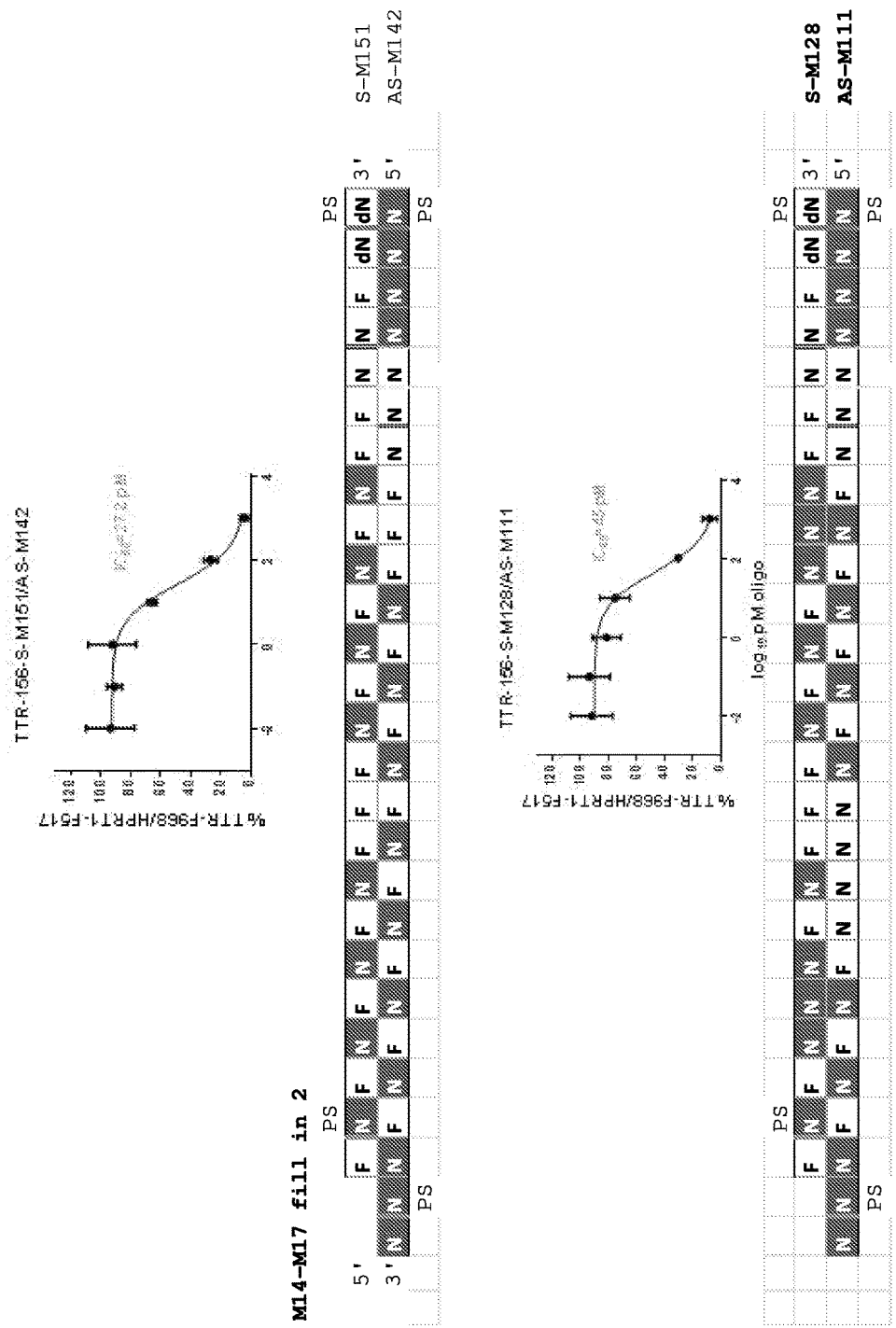
Figure 8E:
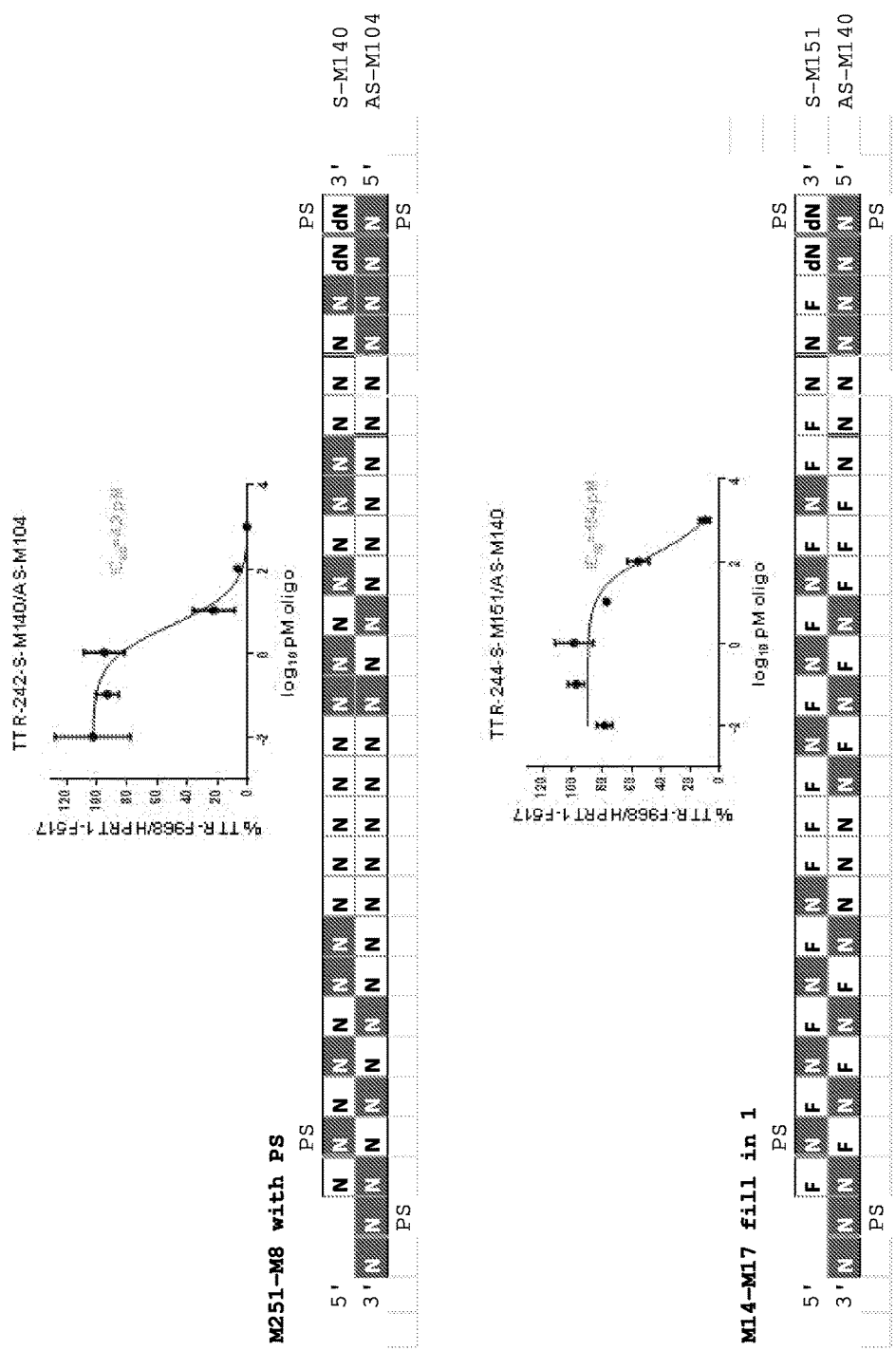
Figure 8F:
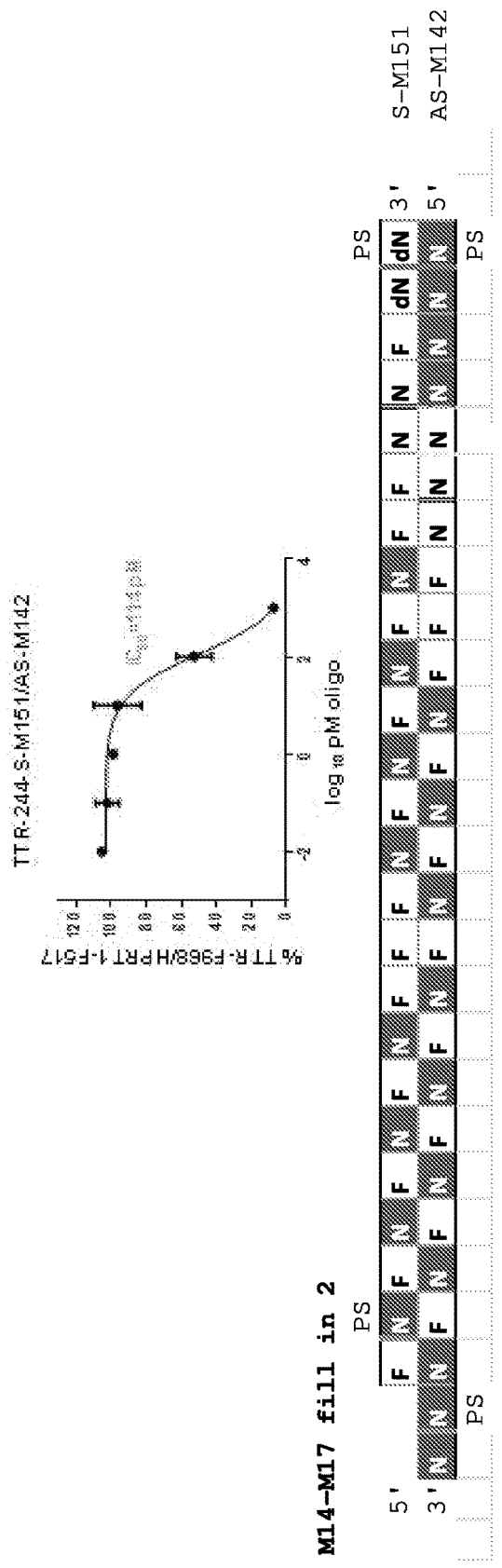

As shown in FIGS. 8A to 8E, confirmatory dose-response curves were performed for each additional modified form of TTR-targeting DsiRNA tested. Dose-response curves for tetraloop formats of FIGS. 8A and 8B confirmed and extended the above finding that such formats possess robust TTR-inhibitory activity. Meanwhile, 2'-F and phosphorothioate (PS) modified forms of TTR-244 were observed to possess high inhibitory activity (FIGS. 8C to 8E). Thus, additional modified forms of TTR-targeting duplexes were identified to possess robust TTR-inhibitory activity.

Example 7: Assessment of In Vivo Efficacy of Transthyretin-Targeting DsiRNAs

The ability of certain, active transthyretin-targeting DsiRNAs to reduce transthyretin levels within a mouse, optionally a mouse model of liver disease is examined. Animals are randomized and assigned to groups based on marker levels. Dosing of animals with lipid nanoparticles (LNPs) containing DsiRNAs (optionally, an LNP formulation named EnCore-2072 is employed) is initiated on day 0. Animals are dosed at 5 mg/kg iv, tiw×2 (6 doses total). Animals are sacrificed 48 hrs after the last dose. Liver is dissected and weighed, and transthyretin levels are assessed (optionally, for a mouse model of a liver disease or disorder, the extent of reduction and/or prevention of the disease or disorder is assessed).

Example 8: Indications

The present body of knowledge in transthyretin research indicates the need for methods to assay transthyretin activity and for compounds that can regulate transthyretin expression for research, diagnostic, and therapeutic use. As described herein, the nucleic acid molecules of the present invention can be used in assays to diagnose disease state related to transthyretin levels. In addition, the nucleic acid molecules can be used to treat disease state related to transthyretin misregulation, levels, etc.

Particular disorders and disease states that can be associated with transthyretin expression modulation include, but are not limited to chronic liver disease, liver inflammation, cirrhosis, liver fibrosis and hepatocellular carcinoma.

Other therapeutic agents can be combined with or used in conjunction with the nucleic acid molecules (e.g. DsiRNA molecules) of the instant invention. Those skilled in the art will recognize that other compounds and therapies used to treat the diseases and conditions described herein can be combined with the nucleic acid molecules of the instant invention (e.g. siNA molecules) and are hence within the scope of the instant invention. For example, for combination therapy, the nucleic acids of the invention can be prepared in one of at least two ways. First, the agents are physically combined in a preparation of nucleic acid and other agent, such as a mixture of a nucleic acid of the invention encapsulated in liposomes and other agent in a solution for intravenous administration, wherein both agents are present in a therapeutically effective concentration (e.g., the other agent in solution to deliver 1000-1250 mg/m2/day and liposome-associated nucleic acid of the invention in the same solution to deliver 0.1-100 mg/kg/day). Alternatively, the agents are administered separately but simultaneously or successively in their respective effective doses (e.g., 1000-1250 mg/m2/d other agent and 0.1 to 100 mg/kg/day nucleic acid of the invention).

Example 9: Serum Stability for DsiRNAs

Serum stability of DsiRNA agents is assessed via incubation of DsiRNA agents in 50% fetal bovine serum for various periods of time (up to 24 h) at 37° C. Serum is extracted and the nucleic acids are separated on a 20% non-denaturing PAGE and can be visualized with Gelstar stain. Relative levels of protection from nuclease degradation are assessed for DsiRNAs (optionally with and without modifications).

Example 10: Diagnostic Uses

The DsiRNA molecules of the invention can be used in a variety of diagnostic applications, such as in the identification of molecular targets (e.g., RNA) in a variety of applications, for example, in clinical, industrial, environmental, agricultural and/or research settings. Such diagnostic use of DsiRNA molecules involves utilizing reconstituted RNAi systems, for example, using cellular lysates or partially purified cellular lysates. DsiRNA molecules of this invention can be used as diagnostic tools to examine genetic drift and mutations within diseased cells. The close relationship between DsiRNA activity and the structure of the target transthyretin RNA allows the detection of mutations in a region of the transthyretin molecule, which alters the base-pairing and three-dimensional structure of the target transthyretin RNA. By using multiple DsiRNA molecules described in this invention, one can map nucleotide changes, which are important to RNA structure and function in vitro, as well as in cells and tissues. Cleavage of target transthyretin RNAs with DsiRNA molecules can be used to inhibit gene expression and define the role of specified gene products in the progression of a transthyretin-associated disease or disorder. In this manner, other genetic targets can be defined as important mediators of the disease. These experiments will lead to better treatment of the disease progression by affording the possibility of combination therapies (e.g., multiple DsiRNA molecules targeted to different genes, DsiRNA molecules coupled with known small molecule inhibitors, or intermittent treatment with combinations of DsiRNA molecules and/or other chemical or biological molecules). Other in vitro uses of DsiRNA molecules of this invention are well known in the art, and include detection of the presence of RNAs associated with a disease or related condition. Such RNA is detected by determining the presence of a cleavage product after treatment with a DsiRNA using standard methodologies, for example, fluorescence resonance emission transfer (FRET).

In a specific example, DsiRNA molecules that cleave only wild-type or mutant or polymorphic forms of the target transthyretin RNA are used for the assay. The first DsiRNA molecules (i.e., those that cleave only wild-type forms of target transthyretin RNA) are used to identify wild-type transthyretin RNA present in the sample and the second DsiRNA molecules (i.e., those that cleave only mutant or polymorphic forms of target RNA) are used to identify mutant or polymorphic transthyretin RNA in the sample. As reaction controls, synthetic substrates of both wild-type and mutant or polymorphic transthyretin RNA are cleaved by both DsiRNA molecules to demonstrate the relative DsiRNA efficiencies in the reactions and the absence of cleavage of the "non-targeted" transthyretin RNA species. The cleavage products from the synthetic substrates also serve to generate size markers for the analysis of wild-type and mutant transthyretin RNAs in the sample population. Thus, each analysis requires two DsiRNA molecules, two substrates and one unknown sample, which is combined into six reactions. The presence of cleavage products is determined using an RNase protection assay so that full-length and cleavage fragments of each transthyretin RNA can be analyzed in one lane of a polyacrylamide gel. It is not absolutely required to quantify the results to gain insight into the expression of mutant or polymorphic transthyretin RNAs and putative risk of transthyretin-associated phenotypic changes in target cells. The expression of transthyretin mRNA whose protein product is implicated in the development of the phenotype (i.e., disease related/associated) is adequate to establish risk. If probes of comparable specific activity are used for both transcripts, then a qualitative comparison of transthyretin RNA levels is adequate and decreases the cost of the initial diagnosis. Higher mutant or polymorphic form to wild-type ratios are correlated with higher risk whether transthyretin RNA levels are compared qualitatively or quantitatively.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can comprise improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying DsiRNA molecules with improved RNAi activity.

The invention illustratively described herein suitably can be practiced in the absence of any element or elements, limitation or limitations that are not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any nonclaimed element as essential to the practice of the invention.

Embodiments of this invention are described herein, including the best mode known to the inventors for carrying out the invention. Variations of those embodiments may become apparent to those of ordinary skill in the art upon reading the foregoing description.

The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context. Those skilled in the art will recognize, or be able to ascertain using no more than routine experimentation, many equivalents to the specific embodiments of the invention described herein. Such equivalents are intended to be encompassed by the following claims.

SEQUENCE LISTING (3479 sequences)

SEQ ID NO: 1 - DNA, 25 bp, Artificial Sequence
  Synthetic oligonucleotide
ugacuaagucaauaaucagaaucag

SEQ ID NO: 2 - DNA, 25 bp, Artificial Sequence
  Synthetic oligonucleotide
gacuaagucaauaaucagaaucagc

SEQ ID NO: 3 - DNA, 25 bp, Artificial Sequence
  Synthetic oligonucleotide
acuaagucaauaaucagaaucagca

SEQ ID NO: 4 - DNA, 25 bp, Artificial Sequence
  Synthetic oligonucleotide
cuaagucaauaaucagaaucagcag

SEQ ID NO: 5 - DNA, 25 bp, Artificial Sequence
  Synthetic oligonucleotide
uaagucaauaaucagaaucagcagg

SEQ ID NO: 6 - DNA, 25 bp, Artificial Sequence
  Synthetic oligonucleotide
aagucaauaaucagaaucagcaggt

SEQ ID NO: 7 - DNA, 25 bp, Artificial Sequence
  Synthetic oligonucleotide
agucaauaaucagaaucagcaggtt

SEQ ID NO: 8 - DNA, 25 bp, Artificial Sequence
  Synthetic oligonucleotide
gucaauaaucagaaucagcaggutt

SEQ ID NO: 9 - DNA, 25 bp, Artificial Sequence
  Synthetic oligonucleotide
ucaauaaucagaaucagcagguutg

SEQ ID NO: 10 - DNA, 25 bp, Artificial Sequence
  Synthetic oligonucleotide
caauaaucagaaucagcagguuugc

SEQ ID NO: 11 - DNA, 25 bp, Artificial Sequence
  Synthetic oligonucleotide
aauaaucagaaucagcagguuugca

SEQ ID NO: 12 - DNA, 25 bp, Artificial Sequence
  Synthetic oligonucleotide
auaaucagaaucagcagguuugcag

SEQ ID NO: 13 - DNA, 25 bp, Artificial Sequence
  Synthetic oligonucleotide
uaaucagaaucagcagguuugcagt

SEQ ID NO: 14 - DNA, 25 bp, Artificial Sequence
  Synthetic oligonucleotide
aaucagaaucagcagguuugcagtc

SEQ ID NO: 15 - DNA, 25 bp, Artificial Sequence
  Synthetic oligonucleotide
aucagaaucagcagguuugcaguca

SEQ ID NO: 16 - DNA, 25 bp, Artificial Sequence
  Synthetic oligonucleotide
cagaaucagcagguuugcagucaga

SEQ ID NO: 17 - DNA, 25 bp, Artificial Sequence
  Synthetic oligonucleotide
agaaucagcagguuugcagucagat

SEQ ID NO: 18 - DNA, 25 bp, Artificial Sequence
  Synthetic oligonucleotide
aaucagcagguuugcagucagautg

SEQ ID NO: 19 - DNA, 25 bp, Artificial Sequence
  Synthetic oligonucleotide
aucagcagguuugcagucagauugg

SEQ ID NO: 20 - DNA, 25 bp, Artificial Sequence
  Synthetic oligonucleotide
gcagucagauuggcagggauaagca

SEQ ID NO: 21 - DNA, 25 bp, Artificial Sequence
  Synthetic oligonucleotide
gccuagcucaggagaagugaguata

SEQ ID NO: 22 - DNA, 25 bp, Artificial Sequence
  Synthetic oligonucleotide
uagcucaggagaagugaguauaaaa

SEQ ID NO: 23 - DNA, 25 bp, Artificial Sequence
  Synthetic oligonucleotide
agcucaggagaagugaguauaaaag

SEQ ID NO: 24 - DNA, 25 bp, Artificial Sequence
  Synthetic oligonucleotide
gcucaggagaagugaguauaaaagc

SEQ ID NO: 25 - DNA, 25 bp, Artificial Sequence
  Synthetic oligonucleotide
cucaggagaagugaguauaaaagcc

SEQ ID NO: 26 - DNA, 25 bp, Artificial Sequence
  Synthetic oligonucleotide
caggagaagugaguauaaaagcccc

SEQ ID NO: 27 - DNA, 25 bp, Artificial Sequence
  Synthetic oligonucleotide
gcagccaucacagaaguccacucat

SEQ ID NO: 28 - DNA, 25 bp, Artificial Sequence
  Synthetic oligonucleotide
cagccaucacagaaguccacucatt

SEQ ID NO: 29 - DNA, 25 bp, Artificial Sequence
  Synthetic oligonucleotide
agccaucacagaaguccacucautc

SEQ ID NO: 30 - DNA, 25 bp, Artificial Sequence
  Synthetic oligonucleotide
gccaucacagaaguccacucauuct

SEQ ID NO: 31 - DNA, 25 bp, Artificial Sequence
  Synthetic oligonucleotide
ccaucacagaaguccacucauuctt

SEQ ID NO: 32 - DNA, 25 bp, Artificial Sequence
  Synthetic oligonucleotide
caucacagaaguccacucauucutg

SEQ ID NO: 33 - DNA, 25 bp, Artificial Sequence
  Synthetic oligonucleotide
aucacagaaguccacucauucuugg

SEQ ID NO: 34 - DNA, 25 bp, Artificial Sequence
  Synthetic oligonucleotide
cacagaaguccacucauucuuggca

SEQ ID NO: 35 - DNA, 25 bp, Artificial Sequence
  Synthetic oligonucleotide
acagaaguccacucauucuuggcag

SEQ ID NO: 36 - DNA, 25 bp, Artificial Sequence
  Synthetic oligonucleotide
uucuuggcaggauggcuucucaucg

SEQ ID NO: 37 - DNA, 25 bp, Artificial Sequence
  Synthetic oligonucleotide
ucuuggcaggauggcuucucaucgt

SEQ ID NO: 38 - DNA, 25 bp, Artificial Sequence
  Synthetic oligonucleotide
cuuggcaggauggcuucucaucgtc

SEQ ID NO: 39 - DNA, 25 bp, Artificial Sequence
  Synthetic oligonucleotide
uuggcaggauggcuucucaucguct

SEQ ID NO: 40 - DNA, 25 bp, Artificial Sequence
  Synthetic oligonucleotide
uggcaggauggcuucucaucguctg

SEQ ID NO: 41 - DNA, 25 bp, Artificial Sequence
  Synthetic oligonucleotide
ggcaggauggcuucucaucgucugc

SEQ ID NO: 42 - DNA, 25 bp, Artificial Sequence
  Synthetic oligonucleotide
gcaggauggcuucucaucgucugct

SEQ ID NO: 43 - DNA, 25 bp, Artificial Sequence
  Synthetic oligonucleotide
caggauggcuucucaucgucugctc

SEQ ID NO: 44 - DNA, 25 bp, Artificial Sequence
  Synthetic oligonucleotide
aggauggcuucucaucgucugcucc

SEQ ID NO: 45 - DNA, 25 bp, Artificial Sequence
  Synthetic oligonucleotide
ggauggcuucucaucgucugcucct

SEQ ID NO: 46 - DNA, 25 bp, Artificial Sequence
  Synthetic oligonucleotide
gauggcuucucaucgucugcucctc

SEQ ID NO: 47 - DNA, 25 bp, Artificial Sequence
  Synthetic oligonucleotide
auggcuucucaucgucugcuccucc

SEQ ID NO: 48 - DNA, 25 bp, Artificial Sequence
  Synthetic oligonucleotide
uggcuucucaucgucugcuccucct

SEQ ID NO: 49 - DNA, 25 bp, Artificial Sequence
  Synthetic oligonucleotide
ggcuucucaucgucugcuccucctc

SEQ ID NO: 50 - DNA, 25 bp, Artificial Sequence
  Synthetic oligonucleotide
gcuucucaucgucugcuccuccuct

SEQ ID NO: 51 - DNA, 25 bp, Artificial Sequence
  Synthetic oligonucleotide
cuucucaucgucugcuccuccuctg

SEQ ID NO: 52 - DNA, 25 bp, Artificial Sequence
  Synthetic oligonucleotide
ucugccuugcuggacugguauuugt

SEQ ID NO: 53 - DNA, 25 bp, Artificial Sequence
  Synthetic oligonucleotide
cugccuugcuggacugguauuugtg

SEQ ID NO: 54 - DNA, 25 bp, Artificial Sequence
  Synthetic oligonucleotide
ccggugaauccaaguguccucugat

SEQ ID NO: 55 - DNA, 25 bp, Artificial Sequence
  Synthetic oligonucleotide
ugaauccaaguguccucugauggtc

SEQ ID NO: 56 - DNA, 25 bp, Artificial Sequence
  Synthetic oligonucleotide
gaauccaaguguccucugaugguca

SEQ ID NO: 57 - DNA, 25 bp, Artificial Sequence
  Synthetic oligonucleotide
aauccaaguguccucugauggucaa

SEQ ID NO: 58 - DNA, 25 bp, Artificial Sequence
  Synthetic oligonucleotide
auccaaguguccucugauggucaaa

SEQ ID NO: 59 - DNA, 25 bp, Artificial Sequence
  Synthetic oligonucleotide
uccaaguguccucugauggucaaag

SEQ ID NO: 60 - DNA, 25 bp, Artificial Sequence
  Synthetic oligonucleotide
ccaaguguccucugauggucaaagt

SEQ ID NO: 61 - DNA, 25 bp, Artificial Sequence
  Synthetic oligonucleotide
caaguguccucugauggucaaagtt

SEQ ID NO: 62 - DNA, 25 bp, Artificial Sequence
  Synthetic oligonucleotide
aaguguccucugauggucaaagutc

SEQ ID NO: 63 - DNA, 25 bp, Artificial Sequence
  Synthetic oligonucleotide
aguguccucugauggucaaaguuct

SEQ ID NO: 64 - DNA, 25 bp, Artificial Sequence
  Synthetic oligonucleotide
guguccucugauggucaaaguucta

SEQ ID NO: 65 - DNA, 25 bp, Artificial Sequence
  Synthetic oligonucleotide
uguccucugauggucaaaguucuag

SEQ ID NO: 66 - DNA, 25 bp, Artificial Sequence
  Synthetic oligonucleotide
guccucugauggucaaaguucuaga

SEQ ID NO: 67 - DNA, 25 bp, Artificial Sequence
  Synthetic oligonucleotide
uccucugauggucaaaguucuagat

SEQ ID NO: 68 - DNA, 25 bp, Artificial Sequence
  Synthetic oligonucleotide
ccucugauggucaaaguucuagatg

SEQ ID NO: 69 - DNA, 25 bp, Artificial Sequence
  Synthetic oligonucleotide
cucugauggucaaaguucuagaugc

SEQ ID NO: 70 - DNA, 25 bp, Artificial Sequence
  Synthetic oligonucleotide
ucugauggucaaaguucuagaugct

SEQ ID NO: 71 - DNA, 25 bp, Artificial Sequence
  Synthetic oligonucleotide
cugauggucaaaguucuagaugctg

SEQ ID NO: 72 - DNA, 25 bp, Artificial Sequence
  Synthetic oligonucleotide
ugauggucaaaguucuagaugcugt

SEQ ID NO: 73 - DNA, 25 bp, Artificial Sequence
  Synthetic oligonucleotide
gauggucaaaguucuagaugcugtc

SEQ ID NO: 74 - DNA, 25 bp, Artificial Sequence
  Synthetic oligonucleotide
auggucaaaguucuagaugcugucc

SEQ ID NO: 75 - DNA, 25 bp, Artificial Sequence
  Synthetic oligonucleotide
uggucaaaguucuagaugcuguccg

SEQ ID NO: 76 - DNA, 25 bp, Artificial Sequence
  Synthetic oligonucleotide
gccauuugccucugggaaaaccagt

SEQ ID NO: 77 - DNA, 25 bp, Artificial Sequence
  Synthetic oligonucleotide
ccauuugccucugggaaaaccagtg

SEQ ID NO: 78 - DNA, 25 bp, Artificial Sequence
  Synthetic oligonucleotide
cauuugccucugggaaaaccaguga

SEQ ID NO: 79 - DNA, 25 bp, Artificial Sequence
  Synthetic oligonucleotide
auuugccucugggaaaaccagugag

SEQ ID NO: 80 - DNA, 25 bp, Artificial Sequence
  Synthetic oligonucleotide
uuugccucugggaaaaccagugagt

SEQ ID NO: 81 - DNA, 25 bp, Artificial Sequence
  Synthetic oligonucleotide
uugccucugggaaaaccagugagtc

SEQ ID NO: 82 - DNA, 25 bp, Artificial Sequence
  Synthetic oligonucleotide
ugccucugggaaaaccagugaguct

SEQ ID NO: 83 - DNA, 25 bp, Artificial Sequence
  Synthetic oligonucleotide
gccucugggaaaaccagugaguctg

SEQ ID NO: 84 - DNA, 25 bp, Artificial Sequence
  Synthetic oligonucleotide
ccucugggaaaaccagugagucugg

SEQ ID NO: 85 - DNA, 25 bp, Artificial Sequence
  Synthetic oligonucleotide
cucugggaaaaccagugagucugga

SEQ ID NO: 86 - DNA, 25 bp, Artificial Sequence
  Synthetic oligonucleotide
ucugggaaaaccagugagucuggag

SEQ ID NO: 87 - DNA, 25 bp, Artificial Sequence
  Synthetic oligonucleotide
cugggaaaaccagugagucuggaga

SEQ ID NO: 88 - DNA, 25 bp, Artificial Sequence
  Synthetic oligonucleotide
ugggaaaaccagugagucuggagag

SEQ ID NO: 89 - DNA, 25 bp, Artificial Sequence
  Synthetic oligonucleotide
gggaaaaccagugagucuggagagc

SEQ ID NO: 90 - DNA, 25 bp, Artificial Sequence
  Synthetic oligonucleotide
ggaaaaccagugagucuggagagct

SEQ ID NO: 91 - DNA, 25 bp, Artificial Sequence
  Synthetic oligonucleotide
gaaaaccagugagucuggagagctg

SEQ ID NO: 92 - DNA, 25 bp, Artificial Sequence
  Synthetic oligonucleotide
agcugcaugggcucacaacugagga

SEQ ID NO: 93 - DNA, 25 bp, Artificial Sequence
  Synthetic oligonucleotide
gcugcaugggcucacaacugaggag

SEQ ID NO: 94 - DNA, 25 bp, Artificial Sequence
  Synthetic oligonucleotide
cugcaugggcucacaacugaggagg

SEQ ID NO: 95 - DNA, 25 bp, Artificial Sequence
  Synthetic oligonucleotide
ugcaugggcucacaacugaggagga

SEQ ID NO: 96 - DNA, 25 bp, Artificial Sequence
  Synthetic oligonucleotide
gcaugggcucacaacugaggaggaa

SEQ ID NO: 97 - DNA, 25 bp, Artificial Sequence
  Synthetic oligonucleotide
caugggcucacaacugaggaggaat

SEQ ID NO: 98 - DNA, 25 bp, Artificial Sequence
  Synthetic oligonucleotide
augggcucacaacugaggaggaatt

SEQ ID NO: 99 - DNA, 25 bp, Artificial Sequence
  Synthetic oligonucleotide
ugggcucacaacugaggaggaautt

SEQ ID NO: 100 - DNA, 25 bp, Artificial Sequence
  Synthetic oligonucleotide
gggcucacaacugaggaggaauutg

SEQ ID NO: 101 - DNA, 25 bp, Artificial Sequence
  Synthetic oligonucleotide
ggcucacaacugaggaggaauuugt

SEQ ID NO: 102 - DNA, 25 bp, Artificial Sequence
  Synthetic oligonucleotide
gcucacaacugaggaggaauuugta

SEQ ID NO: 103 - DNA, 25 bp, Artificial Sequence
  Synthetic oligonucleotide
cucacaacugaggaggaauuuguag

SEQ ID NO: 104 - DNA, 25 bp, Artificial Sequence
  Synthetic oligonucleotide
ucacaacugaggaggaauuuguaga

SEQ ID NO: 105 - DNA, 25 bp, Artificial Sequence
  Synthetic oligonucleotide
cacaacugaggaggaauuuguagaa

SEQ ID NO: 106 - DNA, 25 bp, Artificial Sequence
  Synthetic oligonucleotide
acaacugaggaggaauuuguagaag

SEQ ID NO: 107 - DNA, 25 bp, Artificial Sequence
  Synthetic oligonucleotide
caacugaggaggaauuuguagaagg

SEQ ID NO: 108 - DNA, 25 bp, Artificial Sequence
  Synthetic oligonucleotide
acugaggaggaauuuguagaaggga

SEQ ID NO: 109 - DNA, 25 bp, Artificial Sequence
  Synthetic oligonucleotide
cugaggaggaauuuguagaagggat

SEQ ID NO: 110 - DNA, 25 bp, Artificial Sequence
  Synthetic oligonucleotide
ugaggaggaauuuguagaagggata

SEQ ID NO: 111 - DNA, 25 bp, Artificial Sequence
  Synthetic oligonucleotide
gaggaggaauuuguagaagggauat

SEQ ID NO: 112 - DNA, 25 bp, Artificial Sequence
  Synthetic oligonucleotide
aggaggaauuuguagaagggauata

SEQ ID NO: 113 - DNA, 25 bp, Artificial Sequence
  Synthetic oligonucleotide
ggaggaauuuguagaagggauauac

SEQ ID NO: 114 - DNA, 25 bp, Artificial Sequence
  Synthetic oligonucleotide
gaggaauuuguagaagggauauaca

SEQ ID NO: 115 - DNA, 25 bp, Artificial Sequence
  Synthetic oligonucleotide
aggaauuuguagaagggauauacaa

SEQ ID NO: 116 - DNA, 25 bp, Artificial Sequence
  Synthetic oligonucleotide
ggaauuuguagaagggauauacaaa

SEQ ID NO: 117 - DNA, 25 bp, Artificial Sequence
  Synthetic oligonucleotide
gaauuuguagaagggauauacaaag

SEQ ID NO: 118 - DNA, 25 bp, Artificial Sequence
  Synthetic oligonucleotide
aauuuguagaagggauauacaaagt

SEQ ID NO: 119 - DNA, 25 bp, Artificial Sequence
  Synthetic oligonucleotide
auuuguagaagggauauacaaagtg

SEQ ID NO: 120 - DNA, 25 bp, Artificial Sequence
  Synthetic oligonucleotide
uuuguagaagggauauacaaagugg

SEQ ID NO: 121 - DNA, 25 bp, Artificial Sequence
  Synthetic oligonucleotide
uuguagaagggauauacaaagugga

SEQ ID NO: 122 - DNA, 25 bp, Artificial Sequence
  Synthetic oligonucleotide
uguagaagggauauacaaaguggaa

SEQ ID NO: 123 - DNA, 25 bp, Artificial Sequence
  Synthetic oligonucleotide
guagaagggauauacaaaguggaaa

SEQ ID NO: 124 - DNA, 25 bp, Artificial Sequence
  Synthetic oligonucleotide
uagaagggauauacaaaguggaaat

SEQ ID NO: 125 - DNA, 25 bp, Artificial Sequence
  Synthetic oligonucleotide
agaagggauauacaaaguggaaata

SEQ ID NO: 126 - DNA, 25 bp, Artificial Sequence
  Synthetic oligonucleotide
gaagggauauacaaaguggaaauag

SEQ ID NO: 127 - DNA, 25 bp, Artificial Sequence
  Synthetic oligonucleotide
aagggauauacaaaguggaaauaga

SEQ ID NO: 128 - DNA, 25 bp, Artificial Sequence
  Synthetic oligonucleotide
agggauauacaaaguggaaauagac

SEQ ID NO: 129 - DNA, 25 bp, Artificial Sequence
  Synthetic oligonucleotide
gggauauacaaaguggaaauagaca

SEQ ID NO: 130 - DNA, 25 bp, Artificial Sequence
  Synthetic oligonucleotide
ggauauacaaaguggaaauagacac

SEQ ID NO: 131 - DNA, 25 bp, Artificial Sequence
  Synthetic oligonucleotide
gauauacaaaguggaaauagacacc

SEQ ID NO: 132 - DNA, 25 bp, Artificial Sequence
  Synthetic oligonucleotide
auauacaaaguggaaauagacacca

SEQ ID NO: 133 - DNA, 25 bp, Artificial Sequence
  Synthetic oligonucleotide
uauacaaaguggaaauagacaccaa

SEQ ID NO: 134 - DNA, 25 bp, Artificial Sequence
  Synthetic oligonucleotide
auacaaaguggaaauagacaccaaa

SEQ ID NO: 135 - DNA, 25 bp, Artificial Sequence
  Synthetic oligonucleotide
uacaaaguggaaauagacaccaaat

SEQ ID NO: 136 - DNA, 25 bp, Artificial Sequence
  Synthetic oligonucleotide
acaaaguggaaauagacaccaaatc

SEQ ID NO: 137 - DNA, 25 bp, Artificial Sequence
  Synthetic oligonucleotide
caaaguggaaauagacaccaaauct

SEQ ID NO: 138 - DNA, 25 bp, Artificial Sequence
  Synthetic oligonucleotide
aaaguggaaauagacaccaaauctt

SEQ ID NO: 139 - DNA, 25 bp, Artificial Sequence
  Synthetic oligonucleotide
aaguggaaauagacaccaaaucuta

SEQ ID NO: 140 - DNA, 25 bp, Artificial Sequence
  Synthetic oligonucleotide
aguggaaauagacaccaaaucuuac

SEQ ID NO: 141 - DNA, 25 bp, Artificial Sequence
  Synthetic oligonucleotide
guggaaauagacaccaaaucuuact

SEQ ID NO: 142 - DNA, 25 bp, Artificial Sequence
  Synthetic oligonucleotide
uggaaauagacaccaaaucuuactg

SEQ ID NO: 143 - DNA, 25 bp, Artificial Sequence
  Synthetic oligonucleotide
ggaaauagacaccaaaucuuacugg

SEQ ID NO: 144 - DNA, 25 bp, Artificial Sequence
  Synthetic oligonucleotide
gaaauagacaccaaaucuuacugga

SEQ ID NO: 145 - DNA, 25 bp, Artificial Sequence
  Synthetic oligonucleotide
aaauagacaccaaaucuuacuggaa

SEQ ID NO: 146 - DNA, 25 bp, Artificial Sequence
  Synthetic oligonucleotide
aauagacaccaaaucuuacuggaag

SEQ ID NO: 147 - DNA, 25 bp, Artificial Sequence
  Synthetic oligonucleotide
auagacaccaaaucuuacuggaagg

SEQ ID NO: 148 - DNA, 25 bp, Artificial Sequence
  Synthetic oligonucleotide
agacaccaaaucuuacuggaaggca

SEQ ID NO: 149 - DNA, 25 bp, Artificial Sequence
  Synthetic oligonucleotide
gacaccaaaucuuacuggaaggcac

SEQ ID NO: 150 - DNA, 25 bp, Artificial Sequence
  Synthetic oligonucleotide
cacuuggcaucuccccauuccauga

SEQ ID NO: 151 - DNA, 25 bp, Artificial Sequence
  Synthetic oligonucleotide
acuuggcaucuccccauuccaugag

SEQ ID NO: 152 - DNA, 25 bp, Artificial Sequence
  Synthetic oligonucleotide
cuuggcaucuccccauuccaugagc

SEQ ID NO: 153 - DNA, 25 bp, Artificial Sequence
  Synthetic oligonucleotide
uuggcaucuccccauuccaugagca

SEQ ID NO: 154 - DNA, 25 bp, Artificial Sequence
  Synthetic oligonucleotide
uggcaucuccccauuccaugagcat

SEQ ID NO: 155 - DNA, 25 bp, Artificial Sequence
  Synthetic oligonucleotide
ggcaucuccccauuccaugagcatg

SEQ ID NO: 156 - DNA, 25 bp, Artificial Sequence
  Synthetic oligonucleotide
gcaucuccccauuccaugagcaugc

SEQ ID NO: 157 - DNA, 25 bp, Artificial Sequence
  Synthetic oligonucleotide
caucuccccauuccaugagcaugca

SEQ ID NO: 158 - DNA, 25 bp, Artificial Sequence
  Synthetic oligonucleotide
aucuccccauuccaugagcaugcag

SEQ ID NO: 159 - DNA, 25 bp, Artificial Sequence
  Synthetic oligonucleotide
ucuccccauuccaugagcaugcaga

SEQ ID NO: 160 - DNA, 25 bp, Artificial Sequence
  Synthetic oligonucleotide
cuccccauuccaugagcaugcagag

SEQ ID NO: 161 - DNA, 25 bp, Artificial Sequence
  Synthetic oligonucleotide
uccccauuccaugagcaugcagagg

SEQ ID NO: 162 - DNA, 25 bp, Artificial Sequence
  Synthetic oligonucleotide
ccccauuccaugagcaugcagaggt

SEQ ID NO: 163 - DNA, 25 bp, Artificial Sequence
  Synthetic oligonucleotide
caugagcaugcagaggugguauuca

SEQ ID NO: 164 - DNA, 25 bp, Artificial Sequence
  Synthetic oligonucleotide
augagcaugcagaggugguauucac

SEQ ID NO: 165 - DNA, 25 bp, Artificial Sequence
  Synthetic oligonucleotide
ugagcaugcagaggugguauucaca

SEQ ID NO: 166 - DNA, 25 bp, Artificial Sequence
  Synthetic oligonucleotide
gagcaugcagaggugguauucacag

SEQ ID NO: 167 - DNA, 25 bp, Artificial Sequence
  Synthetic oligonucleotide
augcagaggugguauucacagccaa

SEQ ID NO: 168 - DNA, 25 bp, Artificial Sequence
  Synthetic oligonucleotide
agaggugguauucacagccaacgac

SEQ ID NO: 169 - DNA, 25 bp, Artificial Sequence
  Synthetic oligonucleotide
gaggugguauucacagccaacgact

SEQ ID NO: 170 - DNA, 25 bp, Artificial Sequence
  Synthetic oligonucleotide
gucgucaccaaucccaaggaaugag

SEQ ID NO: 171 - DNA, 25 bp, Artificial Sequence
  Synthetic oligonucleotide
ggacgagggaugggauuucauguaa

SEQ ID NO: 172 - DNA, 25 bp, Artificial Sequence
  Synthetic oligonucleotide
gacgagggaugggauuucauguaac

SEQ ID NO: 173 - DNA, 25 bp, Artificial Sequence
  Synthetic oligonucleotide
gagggaugggauuucauguaaccaa

SEQ ID NO: 174 - DNA, 25 bp, Artificial Sequence
  Synthetic oligonucleotide
agggaugggauuucauguaaccaag

SEQ ID NO: 175 - DNA, 25 bp, Artificial Sequence
  Synthetic oligonucleotide
gggaugggauuucauguaaccaaga

SEQ ID NO: 176 - DNA, 25 bp, Artificial Sequence
  Synthetic oligonucleotide
gaugggauuucauguaaccaagagt

SEQ ID NO: 177 - DNA, 25 bp, Artificial Sequence
  Synthetic oligonucleotide
augggauuucauguaaccaagagta

SEQ ID NO: 178 - DNA, 25 bp, Artificial Sequence
  Synthetic oligonucleotide
ugggauuucauguaaccaagaguat

SEQ ID NO: 179 - DNA, 25 bp, Artificial Sequence
  Synthetic oligonucleotide
gggauuucauguaaccaagaguatt

SEQ ID NO: 180 - DNA, 25 bp, Artificial Sequence
  Synthetic oligonucleotide
ggauuucauguaaccaagaguautc

SEQ ID NO: 181 - DNA, 25 bp, Artificial Sequence
  Synthetic oligonucleotide
gauuucauguaaccaagaguauucc

SEQ ID NO: 182 - DNA, 25 bp, Artificial Sequence
  Synthetic oligonucleotide
auuucauguaaccaagaguauucca

SEQ ID NO: 183 - DNA, 25 bp, Artificial Sequence
  Synthetic oligonucleotide
uuucauguaaccaagaguauuccat

SEQ ID NO: 184 - DNA, 25 bp, Artificial Sequence
  Synthetic oligonucleotide
uucauguaaccaagaguauuccatt

SEQ ID NO: 185 - DNA, 25 bp, Artificial Sequence
  Synthetic oligonucleotide
ucauguaaccaagaguauuccautt

SEQ ID NO: 186 - DNA, 25 bp, Artificial Sequence
  Synthetic oligonucleotide
cauguaaccaagaguauuccauutt

SEQ ID NO: 187 - DNA, 25 bp, Artificial Sequence
  Synthetic oligonucleotide
auguaaccaagaguauuccauuutt

SEQ ID NO: 188 - DNA, 25 bp, Artificial Sequence
  Synthetic oligonucleotide
uguaaccaagaguauuccauuuuta

SEQ ID NO: 189 - DNA, 25 bp, Artificial Sequence
  Synthetic oligonucleotide
guaaccaagaguauuccauuuuuac

SEQ ID NO: 190 - DNA, 25 bp, Artificial Sequence
  Synthetic oligonucleotide
uaaccaagaguauuccauuuuuact

SEQ ID NO: 191 - DNA, 25 bp, Artificial Sequence
  Synthetic oligonucleotide
aaccaagaguauuccauuuuuacta

SEQ ID NO: 192 - DNA, 25 bp, Artificial Sequence
  Synthetic oligonucleotide
accaagaguauuccauuuuuacuaa

SEQ ID NO: 193 - DNA, 25 bp, Artificial Sequence
  Synthetic oligonucleotide
ccaagaguauuccauuuuuacuaaa

SEQ ID NO: 194 - DNA, 25 bp, Artificial Sequence
  Synthetic oligonucleotide
caagaguauuccauuuuuacuaaag

SEQ ID NO: 195 - DNA, 25 bp, Artificial Sequence
  Synthetic oligonucleotide
aagaguauuccauuuuuacuaaagc

SEQ ID NO: 196 - DNA, 25 bp, Artificial Sequence
  Synthetic oligonucleotide
agaguauuccauuuuuacuaaagca

SEQ ID NO: 197 - DNA, 25 bp, Artificial Sequence
  Synthetic oligonucleotide
gaguauuccauuuuuacuaaagcag

SEQ ID NO: 198 - DNA, 25 bp, Artificial Sequence
  Synthetic oligonucleotide
aguauuccauuuuuacuaaagcagt

SEQ ID NO: 199 - DNA, 25 bp, Artificial Sequence
  Synthetic oligonucleotide
guauuccauuuuuacuaaagcagtg

SEQ ID NO: 200 - DNA, 25 bp, Artificial Sequence
  Synthetic oligonucleotide
uauuccauuuuuacuaaagcagugt

SEQ ID NO: 201 - DNA, 25 bp, Artificial Sequence
  Synthetic oligonucleotide
auuccauuuuuacuaaagcagugtt

SEQ ID NO: 202 - DNA, 25 bp, Artificial Sequence
  Synthetic oligonucleotide
uuccauuuuuacuaaagcagugutt

SEQ ID NO: 203 - DNA, 25 bp, Artificial Sequence
  Synthetic oligonucleotide
uccauuuuuacuaaagcaguguutt

SEQ ID NO: 204 - DNA, 25 bp, Artificial Sequence
  Synthetic oligonucleotide
ccauuuuuacuaaagcaguguuutc

SEQ ID NO: 205 - DNA, 25 bp, Artificial Sequence
  Synthetic oligonucleotide
cauuuuuacuaaagcaguguuuuca

SEQ ID NO: 206 - DNA, 25 bp, Artificial Sequence
  Synthetic oligonucleotide
auuuuuacuaaagcaguguuuucac

SEQ ID NO: 207 - DNA, 25 bp, Artificial Sequence
  Synthetic oligonucleotide
uuuuuacuaaagcaguguuuucacc

SEQ ID NO: 208 - DNA, 25 bp, Artificial Sequence
  Synthetic oligonucleotide
uuuuacuaaagcaguguuuucacct

SEQ ID NO: 209 - DNA, 25 bp, Artificial Sequence
  Synthetic oligonucleotide
uuuacuaaagcaguguuuucacctc

SEQ ID NO: 210 - DNA, 25 bp, Artificial Sequence
  Synthetic oligonucleotide
uuacuaaagcaguguuuucaccuca

SEQ ID NO: 211 - DNA, 25 bp, Artificial Sequence
  Synthetic oligonucleotide
uacuaaagcaguguuuucaccucat

SEQ ID NO: 212 - DNA, 25 bp, Artificial Sequence
  Synthetic oligonucleotide
acuaaagcaguguuuucaccucata

SEQ ID NO: 213 - DNA, 25 bp, Artificial Sequence
  Synthetic oligonucleotide
cuaaagcaguguuuucaccucauat

SEQ ID NO: 214 - DNA, 25 bp, Artificial Sequence
  Synthetic oligonucleotide
uaaagcaguguuuucaccucauatg

SEQ ID NO: 215 - DNA, 25 bp, Artificial Sequence
  Synthetic oligonucleotide
aaagcaguguuuucaccucauaugc

SEQ ID NO: 216 - DNA, 25 bp, Artificial Sequence
  Synthetic oligonucleotide
aagcaguguuuucaccucauaugct

SEQ ID NO: 217 - DNA, 25 bp, Artificial Sequence
  Synthetic oligonucleotide
agcaguguuuucaccucauaugcta

SEQ ID NO: 218 - DNA, 25 bp, Artificial Sequence
  Synthetic oligonucleotide
gcaguguuuucaccucauaugcuat

SEQ ID NO: 219 - DNA, 25 bp, Artificial Sequence
  Synthetic oligonucleotide
caguguuuucaccucauaugcuatg

SEQ ID NO: 220 - DNA, 25 bp, Artificial Sequence
  Synthetic oligonucleotide
aguguuuucaccucauaugcuaugt

SEQ ID NO: 221 - DNA, 25 bp, Artificial Sequence
  Synthetic oligonucleotide
guguuuucaccucauaugcuaugtt

SEQ ID NO: 222 - DNA, 25 bp, Artificial Sequence
  Synthetic oligonucleotide
uguuuucaccucauaugcuauguta

SEQ ID NO: 223 - DNA, 25 bp, Artificial Sequence
  Synthetic oligonucleotide
guuuucaccucauaugcuauguuag

SEQ ID NO: 224 - DNA, 25 bp, Artificial Sequence
  Synthetic oligonucleotide
uuuucaccucauaugcuauguuaga

SEQ ID NO: 225 - DNA, 25 bp, Artificial Sequence
  Synthetic oligonucleotide
uuucaccucauaugcuauguuagaa

SEQ ID NO: 226 - DNA, 25 bp, Artificial Sequence
  Synthetic oligonucleotide
uucaccucauaugcuauguuagaag

SEQ ID NO: 227 - DNA, 25 bp, Artificial Sequence
  Synthetic oligonucleotide
ucaccucauaugcuauguuagaagt

SEQ ID NO: 228 - DNA, 25 bp, Artificial Sequence
  Synthetic oligonucleotide
caccucauaugcuauguuagaagtc

SEQ ID NO: 229 - DNA, 25 bp, Artificial Sequence
  Synthetic oligonucleotide
accucauaugcuauguuagaagucc

SEQ ID NO: 230 - DNA, 25 bp, Artificial Sequence
  Synthetic oligonucleotide
ccucauaugcuauguuagaagucca

SEQ ID NO: 231 - DNA, 25 bp, Artificial Sequence
  Synthetic oligonucleotide
cucauaugcuauguuagaaguccag

SEQ ID NO: 232 - DNA, 25 bp, Artificial Sequence
  Synthetic oligonucleotide
ucauaugcuauguuagaaguccagg

SEQ ID NO: 233 - DNA, 25 bp, Artificial Sequence
  Synthetic oligonucleotide
cauaugcuauguuagaaguccaggc

SEQ ID NO: 234 - DNA, 25 bp, Artificial Sequence
  Synthetic oligonucleotide
auaugcuauguuagaaguccaggca

SEQ ID NO: 235 - DNA, 25 bp, Artificial Sequence
  Synthetic oligonucleotide
uaugcuauguuagaaguccaggcag

SEQ ID NO: 236 - DNA, 25 bp, Artificial Sequence
  Synthetic oligonucleotide
augcuauguuagaaguccaggcaga

SEQ ID NO: 237 - DNA, 25 bp, Artificial Sequence
  Synthetic oligonucleotide
cuauguuagaaguccaggcagagac

SEQ ID NO: 238 - DNA, 25 bp, Artificial Sequence
  Synthetic oligonucleotide
auguuagaaguccaggcagagacaa

SEQ ID NO: 239 - DNA, 25 bp, Artificial Sequence
  Synthetic oligonucleotide
uguuagaaguccaggcagagacaat

SEQ ID NO: 240 - DNA, 25 bp, Artificial Sequence
  Synthetic oligonucleotide
guuagaaguccaggcagagacaata

SEQ ID NO: 241 - DNA, 25 bp, Artificial Sequence
  Synthetic oligonucleotide
uuagaaguccaggcagagacaauaa

SEQ ID NO: 242 - DNA, 25 bp, Artificial Sequence
  Synthetic oligonucleotide
uagaaguccaggcagagacaauaaa

SEQ ID NO: 243 - DNA, 25 bp, Artificial Sequence
  Synthetic oligonucleotide
agaaguccaggcagagacaauaaaa

SEQ ID NO: 244 - DNA, 25 bp, Artificial Sequence
  Synthetic oligonucleotide
gaaguccaggcagagacaauaaaac

SEQ ID NO: 245 - DNA, 25 bp, Artificial Sequence
  Synthetic oligonucleotide
aaguccaggcagagacaauaaaaca

SEQ ID NO: 246 - DNA, 25 bp, Artificial Sequence
  Synthetic oligonucleotide
aguccaggcagagacaauaaaacat

SEQ ID NO: 247 - DNA, 25 bp, Artificial Sequence
  Synthetic oligonucleotide
guccaggcagagacaauaaaacatt

SEQ ID NO: 248 - DNA, 25 bp, Artificial Sequence
  Synthetic oligonucleotide
uccaggcagagacaauaaaacautc

SEQ ID NO: 249 - DNA, 25 bp, Artificial Sequence
  Synthetic oligonucleotide
caggcagagacaauaaaacauucct

SEQ ID NO: 250 - DNA, 25 bp, Artificial Sequence
  Synthetic oligonucleotide
aggcagagacaauaaaacauucctg

SEQ ID NO: 251 - DNA, 25 bp, Artificial Sequence
  Synthetic oligonucleotide
ggcagagacaauaaaacauuccugt

SEQ ID NO: 252 - DNA, 25 bp, Artificial Sequence
  Synthetic oligonucleotide
gcagagacaauaaaacauuccugtg

SEQ ID NO: 253 - DNA, 25 bp, Artificial Sequence
  Synthetic oligonucleotide
cagagacaauaaaacauuccuguga

SEQ ID NO: 254 - DNA, 25 bp, Artificial Sequence
  Synthetic oligonucleotide
agagacaauaaaacauuccugugaa

SEQ ID NO: 255 - DNA, 25 bp, Artificial Sequence
  Synthetic oligonucleotide
gagacaauaaaacauuccugugaaa

SEQ ID NO: 256 - DNA, 25 bp, Artificial Sequence
  Synthetic oligonucleotide
agacaauaaaacauuccugugaaag

SEQ ID NO: 257 - DNA, 25 bp, Artificial Sequence
  Synthetic oligonucleotide
gacaauaaaacauuccugugaaagg

SEQ ID NO: 258 - DNA, 25 bp, Artificial Sequence
  Synthetic oligonucleotide
acaauaaaacauuccugugaaaggc

SEQ ID NO: 259 - DNA, 25 bp, Artificial Sequence
  Synthetic oligonucleotide
caauaaaacauuccugugaaaggca

SEQ ID NO: 260 - DNA, 25 bp, Artificial Sequence
  Synthetic oligonucleotide
aauaaaacauuccugugaaaggcac

SEQ ID NO: 261 - DNA, 25 bp, Artificial Sequence
  Synthetic oligonucleotide
auaaaacauuccugugaaaggcact

SEQ ID NO: 262 - DNA, 25 bp, Artificial Sequence
  Synthetic oligonucleotide
aaacauuccugugaaaggcacuutt

SEQ ID NO: 263 - DNA, 25 bp, Artificial Sequence
  Synthetic oligonucleotide
aacauuccugugaaaggcacuuutc

SEQ ID NO: 264 - DNA, 25 bp, Artificial Sequence
  Synthetic oligonucleotide
acauuccugugaaaggcacuuuuca

SEQ ID NO: 265 - DNA, 25 bp, Artificial Sequence
  Synthetic oligonucleotide
cauuccugugaaaggcacuuuucat

SEQ ID NO: 266 - DNA, 25 bp, Artificial Sequence
  Synthetic oligonucleotide
auuccugugaaaggcacuuuucatt

SEQ ID NO: 267 - DNA, 25 bp, Artificial Sequence
  Synthetic oligonucleotide
uuccugugaaaggcacuuuucautc

SEQ ID NO: 268 - DNA, 25 bp, Artificial Sequence
  Synthetic oligonucleotide
ccugugaaaggcacuuuucauucca

SEQ ID NO: 269 - DNA, 25 bp, Artificial Sequence
  Synthetic oligonucleotide
cugugaaaggcacuuuucauuccac

SEQ ID NO: 270 - DNA, 25 bp, Artificial Sequence
  Synthetic oligonucleotide
ugugaaaggcacuuuucauuccact

SEQ ID NO: 271 - DNA, 25 bp, Artificial Sequence
  Synthetic oligonucleotide
gugaaaggcacuuuucauuccactt

SEQ ID NO: 272 - DNA, 25 bp, Artificial Sequence
  Synthetic oligonucleotide
ugaaaggcacuuuucauuccacutt

SEQ ID NO: 273 - DNA, 25 bp, Artificial Sequence
  Synthetic oligonucleotide
gaaaggcacuuuucauuccacuuta

SEQ ID NO: 274 - DNA, 25 bp, Artificial Sequence
  Synthetic oligonucleotide
aaaggcacuuuucauuccacuuuaa

SEQ ID NO: 275 - DNA, 25 bp, Artificial Sequence
  Synthetic oligonucleotide
aaggcacuuuucauuccacuuuaac

SEQ ID NO: 276 - DNA, 25 bp, Artificial Sequence
  Synthetic oligonucleotide
aggcacuuuucauuccacuuuaact

SEQ ID NO: 277 - DNA, 25 bp, Artificial Sequence
  Synthetic oligonucleotide
ggcacuuuucauuccacuuuaactt

SEQ ID NO: 278 - DNA, 25 bp, Artificial Sequence
  Synthetic oligonucleotide
gcacuuuucauuccacuuuaacutg

SEQ ID NO: 279 - DNA, 25 bp, Artificial Sequence
  Synthetic oligonucleotide
cacuuuucauuccacuuuaacuuga

SEQ ID NO: 280 - DNA, 25 bp, Artificial Sequence
  Synthetic oligonucleotide
acuuuucauuccacuuuaacuugat

SEQ ID NO: 281 - DNA, 25 bp, Artificial Sequence
  Synthetic oligonucleotide
cuuuucauuccacuuuaacuugatt

SEQ ID NO: 282 - DNA, 25 bp, Artificial Sequence
  Synthetic oligonucleotide
uuuucauuccacuuuaacuugautt

SEQ ID NO: 283 - DNA, 25 bp, Artificial Sequence
  Synthetic oligonucleotide
uuucauuccacuuuaacuugauutt

SEQ ID NO: 284 - DNA, 25 bp, Artificial Sequence
  Synthetic oligonucleotide
uucauuccacuuuaacuugauuutt

SEQ ID NO: 285 - DNA, 25 bp, Artificial Sequence
  Synthetic oligonucleotide
ucauuccacuuuaacuugauuuutt

SEQ ID NO: 286 - DNA, 25 bp, Artificial Sequence
  Synthetic oligonucleotide
cauuccacuuuaacuugauuuuuta

SEQ ID NO: 287 - DNA, 25 bp, Artificial Sequence
  Synthetic oligonucleotide
auuccacuuuaacuugauuuuuuaa

SEQ ID NO: 288 - DNA, 25 bp, Artificial Sequence
  Synthetic oligonucleotide
uuccacuuuaacuugauuuuuuaaa

SEQ ID NO: 289 - DNA, 25 bp, Artificial Sequence
  Synthetic oligonucleotide
uccacuuuaacuugauuuuuuaaat

SEQ ID NO: 290 - DNA, 25 bp, Artificial Sequence
  Synthetic oligonucleotide
ccacuuuaacuugauuuuuuaaatt

SEQ ID NO: 291 - DNA, 25 bp, Artificial Sequence
  Synthetic oligonucleotide
cacuuuaacuugauuuuuuaaautc

SEQ ID NO: 292 - DNA, 25 bp, Artificial Sequence
  Synthetic oligonucleotide
acuuuaacuugauuuuuuaaauucc

SEQ ID NO: 293 - DNA, 25 bp, Artificial Sequence
  Synthetic oligonucleotide
cuuuaacuugauuuuuuaaauuccc

SEQ ID NO: 294 - DNA, 25 bp, Artificial Sequence
  Synthetic oligonucleotide
uuuaacuugauuuuuuaaauuccct

SEQ ID NO: 295 - DNA, 25 bp, Artificial Sequence
  Synthetic oligonucleotide
uuaacuugauuuuuuaaauuccctt

SEQ ID NO: 296 - DNA, 25 bp, Artificial Sequence
  Synthetic oligonucleotide
uaacuugauuuuuuaaauucccuta

SEQ ID NO: 297 - DNA, 25 bp, Artificial Sequence
  Synthetic oligonucleotide
aacuugauuuuuuaaauucccuuat

SEQ ID NO: 298 - DNA, 25 bp, Artificial Sequence
  Synthetic oligonucleotide
acuugauuuuuuaaauucccuuatt

SEQ ID NO: 299 - DNA, 25 bp, Artificial Sequence
  Synthetic oligonucleotide
cuugauuuuuuaaauucccuuautg

SEQ ID NO: 300 - DNA, 25 bp, Artificial Sequence
  Synthetic oligonucleotide
uugauuuuuuaaauucccuuauugt

SEQ ID NO: 301 - DNA, 25 bp, Artificial Sequence
  Synthetic oligonucleotide
ugauuuuuuaaauucccuuauugtc

SEQ ID NO: 302 - DNA, 25 bp, Artificial Sequence
  Synthetic oligonucleotide
gauuuuuuaaauucccuuauugucc

SEQ ID NO: 303 - DNA, 25 bp, Artificial Sequence
  Synthetic oligonucleotide
auuuuuuaaauucccuuauuguccc

SEQ ID NO: 304 - DNA, 25 bp, Artificial Sequence
  Synthetic oligonucleotide
uuuuuaaauucccuuauuguccctt

SEQ ID NO: 305 - DNA, 25 bp, Artificial Sequence
  Synthetic oligonucleotide
aaauucccuuauugucccuuccaaa

SEQ ID NO: 306 - DNA, 25 bp, Artificial Sequence
  Synthetic oligonucleotide
aauucccuuauugucccuuccaaaa

SEQ ID NO: 307 - DNA, 25 bp, Artificial Sequence
  Synthetic oligonucleotide
ucccuuauugucccuuccaaaaaaa

SEQ ID NO: 308 - DNA, 25 bp, Artificial Sequence
  Synthetic oligonucleotide
aaaaagagaaucaaaauuuuacaaa

SEQ ID NO: 309 - DNA, 25 bp, Artificial Sequence
  Synthetic oligonucleotide
aaaagagaaucaaaauuuuacaaag

SEQ ID NO: 310 - DNA, 25 bp, Artificial Sequence
  Synthetic oligonucleotide
aaagagaaucaaaauuuuacaaaga

SEQ ID NO: 311 - DNA, 25 bp, Artificial Sequence
  Synthetic oligonucleotide
aagagaaucaaaauuuuacaaagaa

SEQ ID NO: 312 - DNA, 25 bp, Artificial Sequence
  Synthetic oligonucleotide
agagaaucaaaauuuuacaaagaat

SEQ ID NO: 313 - DNA, 25 bp, Artificial Sequence
  Synthetic oligonucleotide
gagaaucaaaauuuuacaaagaatc

SEQ ID NO: 314 - DNA, 25 bp, Artificial Sequence
  Synthetic oligonucleotide
agaaucaaaauuuuacaaagaauca

SEQ ID NO: 315 - DNA, 25 bp, Artificial Sequence
  Synthetic oligonucleotide
gaaucaaaauuuuacaaagaaucaa

SEQ ID NO: 316 - DNA, 25 bp, Artificial Sequence
  Synthetic oligonucleotide
aaucaaaauuuuacaaagaaucaaa

SEQ ID NO: 317 - DNA, 25 bp, Artificial Sequence
  Synthetic oligonucleotide
aucaaaauuuuacaaagaaucaaag

SEQ ID NO: 318 - DNA, 25 bp, Artificial Sequence
  Synthetic oligonucleotide
ucaaaauuuuacaaagaaucaaagg

SEQ ID NO: 319 - DNA, 25 bp, Artificial Sequence
  Synthetic oligonucleotide
caaaauuuuacaaagaaucaaagga

SEQ ID NO: 320 - DNA, 25 bp, Artificial Sequence
  Synthetic oligonucleotide
aaaauuuuacaaagaaucaaaggaa

SEQ ID NO: 321 - DNA, 25 bp, Artificial Sequence
  Synthetic oligonucleotide
aaauuuuacaaagaaucaaaggaat

SEQ ID NO: 322 - DNA, 25 bp, Artificial Sequence
  Synthetic oligonucleotide
aauuuuacaaagaaucaaaggaatt

SEQ ID NO: 323 - DNA, 25 bp, Artificial Sequence
  Synthetic oligonucleotide
uuuuacaaagaaucaaaggaauuct

SEQ ID NO: 324 - DNA, 25 bp, Artificial Sequence
  Synthetic oligonucleotide
uuuacaaagaaucaaaggaauucta

SEQ ID NO: 325 - DNA, 25 bp, Artificial Sequence
  Synthetic oligonucleotide
uuacaaagaaucaaaggaauucuag

SEQ ID NO: 326 - DNA, 25 bp, Artificial Sequence
  Synthetic oligonucleotide
uacaaagaaucaaaggaauucuaga

SEQ ID NO: 327 - DNA, 25 bp, Artificial Sequence
  Synthetic oligonucleotide
acaaagaaucaaaggaauucuagaa

SEQ ID NO: 328 - DNA, 25 bp, Artificial Sequence
  Synthetic oligonucleotide
caaagaaucaaaggaauucuagaaa

SEQ ID NO: 329 - DNA, 25 bp, Artificial Sequence
  Synthetic oligonucleotide
aaagaaucaaaggaauucuagaaag

SEQ ID NO: 330 - DNA, 25 bp, Artificial Sequence
  Synthetic oligonucleotide
aagaaucaaaggaauucuagaaagt

SEQ ID NO: 331 - DNA, 25 bp, Artificial Sequence
  Synthetic oligonucleotide
agaaucaaaggaauucuagaaagta

SEQ ID NO: 332 - DNA, 25 bp, Artificial Sequence
  Synthetic oligonucleotide
gaaucaaaggaauucuagaaaguat

SEQ ID NO: 333 - DNA, 25 bp, Artificial Sequence
  Synthetic oligonucleotide
aaucaaaggaauucuagaaaguatc

SEQ ID NO: 334 - DNA, 25 bp, Artificial Sequence
  Synthetic oligonucleotide
aucaaaggaauucuagaaaguauct

SEQ ID NO: 335 - DNA, 25 bp, Artificial Sequence
  Synthetic oligonucleotide
ucaaaggaauucuagaaaguauctg

SEQ ID NO: 336 - DNA, 25 bp, Artificial Sequence
  Synthetic oligonucleotide
caaaggaauucuagaaaguaucugg

SEQ ID NO: 337 - DNA, 25 bp, Artificial Sequence
  Synthetic oligonucleotide
aaaggaauucuagaaaguaucuggg

SEQ ID NO: 338 - DNA, 25 bp, Artificial Sequence
  Synthetic oligonucleotide
aggagagauccaaauuuccauugtc

SEQ ID NO: 339 - DNA, 25 bp, Artificial Sequence
  Synthetic oligonucleotide
ggagagauccaaauuuccauuguct

SEQ ID NO: 340 - DNA, 25 bp, Artificial Sequence
  Synthetic oligonucleotide
gagauccaaauuuccauugucuugc

SEQ ID NO: 341 - DNA, 25 bp, Artificial Sequence
  Synthetic oligonucleotide
agauccaaauuuccauugucuugca

SEQ ID NO: 342 - DNA, 25 bp, Artificial Sequence
  Synthetic oligonucleotide
gauccaaauuuccauugucuugcaa

SEQ ID NO: 343 - DNA, 25 bp, Artificial Sequence
  Synthetic oligonucleotide
auccaaauuuccauugucuugcaag

SEQ ID NO: 344 - DNA, 25 bp, Artificial Sequence
  Synthetic oligonucleotide
uccaaauuuccauugucuugcaagc

SEQ ID NO: 345 - DNA, 25 bp, Artificial Sequence
  Synthetic oligonucleotide
ccaaauuuccauugucuugcaagca

SEQ ID NO: 346 - DNA, 25 bp, Artificial Sequence
  Synthetic oligonucleotide
caaauuuccauugucuugcaagcaa

SEQ ID NO: 347 - DNA, 25 bp, Artificial Sequence
  Synthetic oligonucleotide
aaauuuccauugucuugcaagcaaa

SEQ ID NO: 348 - DNA, 25 bp, Artificial Sequence
  Synthetic oligonucleotide
aauuuccauugucuugcaagcaaag

SEQ ID NO: 349 - DNA, 25 bp, Artificial Sequence
  Synthetic oligonucleotide
auuuccauugucuugcaagcaaagc

SEQ ID NO: 350 - DNA, 25 bp, Artificial Sequence
  Synthetic oligonucleotide
uuuccauugucuugcaagcaaagca

SEQ ID NO: 351 - DNA, 25 bp, Artificial Sequence
  Synthetic oligonucleotide
uuccauugucuugcaagcaaagcac

SEQ ID NO: 352 - DNA, 25 bp, Artificial Sequence
  Synthetic oligonucleotide
uccauugucuugcaagcaaagcacg

SEQ ID NO: 353 - DNA, 25 bp, Artificial Sequence
  Synthetic oligonucleotide
ccauugucuugcaagcaaagcacgt

SEQ ID NO: 354 - DNA, 25 bp, Artificial Sequence
  Synthetic oligonucleotide
cauugucuugcaagcaaagcacgta

SEQ ID NO: 355 - DNA, 25 bp, Artificial Sequence
  Synthetic oligonucleotide
auugucuugcaagcaaagcacguat

SEQ ID NO: 356 - DNA, 25 bp, Artificial Sequence
  Synthetic oligonucleotide
uugucuugcaagcaaagcacguatt

SEQ ID NO: 357 - DNA, 25 bp, Artificial Sequence
  Synthetic oligonucleotide
ugucuugcaagcaaagcacguauta

SEQ ID NO: 358 - DNA, 25 bp, Artificial Sequence
  Synthetic oligonucleotide
gucuugcaagcaaagcacguauuaa

SEQ ID NO: 359 - DNA, 25 bp, Artificial Sequence
  Synthetic oligonucleotide
ucuugcaagcaaagcacguauuaaa

SEQ ID NO: 360 - DNA, 25 bp, Artificial Sequence
  Synthetic oligonucleotide
cuugcaagcaaagcacguauuaaat

SEQ ID NO: 361 - DNA, 25 bp, Artificial Sequence
  Synthetic oligonucleotide
uugcaagcaaagcacguauuaaata

SEQ ID NO: 362 - DNA, 25 bp, Artificial Sequence
  Synthetic oligonucleotide
ugcaagcaaagcacguauuaaauat

SEQ ID NO: 363 - DNA, 25 bp, Artificial Sequence
  Synthetic oligonucleotide
gcaagcaaagcacguauuaaauatg

SEQ ID NO: 364 - DNA, 25 bp, Artificial Sequence
  Synthetic oligonucleotide
caagcaaagcacguauuaaauauga

SEQ ID NO: 365 - DNA, 25 bp, Artificial Sequence
  Synthetic oligonucleotide
aagcaaagcacguauuaaauaugat

SEQ ID NO: 366 - DNA, 25 bp, Artificial Sequence
  Synthetic oligonucleotide
agcaaagcacguauuaaauaugatc

SEQ ID NO: 367 - DNA, 25 bp, Artificial Sequence
  Synthetic oligonucleotide
gcaaagcacguauuaaauaugauct

SEQ ID NO: 368 - DNA, 25 bp, Artificial Sequence
  Synthetic oligonucleotide
caaagcacguauuaaauaugauctg

SEQ ID NO: 369 - DNA, 25 bp, Artificial Sequence
  Synthetic oligonucleotide
aaagcacguauuaaauaugaucugc

SEQ ID NO: 370 - DNA, 25 bp, Artificial Sequence
  Synthetic oligonucleotide
aagcacguauuaaauaugaucugca

SEQ ID NO: 371 - DNA, 25 bp, Artificial Sequence
  Synthetic oligonucleotide
agcacguauuaaauaugaucugcag

SEQ ID NO: 372 - DNA, 25 bp, Artificial Sequence
  Synthetic oligonucleotide
gcacguauuaaauaugaucugcagc

SEQ ID NO: 373 - DNA, 25 bp, Artificial Sequence
  Synthetic oligonucleotide
cacguauuaaauaugaucugcagcc

SEQ ID NO: 374 - DNA, 25 bp, Artificial Sequence
  Synthetic oligonucleotide
cguauuaaauaugaucugcagccat

SEQ ID NO: 375 - DNA, 25 bp, Artificial Sequence
  Synthetic oligonucleotide
guauuaaauaugaucugcagccatt

SEQ ID NO: 376 - DNA, 25 bp, Artificial Sequence
  Synthetic oligonucleotide
auuaaauaugaucugcagccauuaa

SEQ ID NO: 377 - DNA, 25 bp, Artificial Sequence
  Synthetic oligonucleotide
uuaaauaugaucugcagccauuaaa

SEQ ID NO: 378 - DNA, 25 bp, Artificial Sequence
  Synthetic oligonucleotide
uaaauaugaucugcagccauuaaaa

SEQ ID NO: 379 - DNA, 25 bp, Artificial Sequence
  Synthetic oligonucleotide
aaauaugaucugcagccauuaaaaa

SEQ ID NO: 380 - DNA, 25 bp, Artificial Sequence
  Synthetic oligonucleotide
aauaugaucugcagccauuaaaaag

SEQ ID NO: 381 - DNA, 25 bp, Artificial Sequence
  Synthetic oligonucleotide
auaugaucugcagccauuaaaaaga

SEQ ID NO: 382 - DNA, 25 bp, Artificial Sequence
  Synthetic oligonucleotide
uaugaucugcagccauuaaaaagac

SEQ ID NO: 383 - DNA, 25 bp, Artificial Sequence
  Synthetic oligonucleotide
augaucugcagccauuaaaaagaca

SEQ ID NO: 384 - DNA, 25 bp, Artificial Sequence
  Synthetic oligonucleotide
ugaucugcagccauuaaaaagacac

SEQ ID NO: 385 - RNA, 27 nt, Artificial Sequence
  Synthetic oligonucleotide
cugauucugauuauugacuuagucaac

SEQ ID NO: 386 - RNA, 27 nt, Artificial Sequence
  Synthetic oligonucleotide
gcugauucugauuauugacuuagucaa

SEQ ID NO: 387 - RNA, 27 nt, Artificial Sequence
  Synthetic oligonucleotide
ugcugauucugauuauugacuuaguca

SEQ ID NO: 388 - RNA, 27 nt, Artificial Sequence
  Synthetic oligonucleotide
cugcugauucugauuauugacuuaguc

SEQ ID NO: 389 - RNA, 27 nt, Artificial Sequence
  Synthetic oligonucleotide
ccugcugauucugauuauugacuuagu

SEQ ID NO: 390 - RNA, 27 nt, Artificial Sequence
  Synthetic oligonucleotide
accugcugauucugauuauugacuuag

SEQ ID NO: 391 - RNA, 27 nt, Artificial Sequence
  Synthetic oligonucleotide
aaccugcugauucugauuauugacuua

SEQ ID NO: 392 - RNA, 27 nt, Artificial Sequence
  Synthetic oligonucleotide
aaaccugcugauucugauuauugacuu

SEQ ID NO: 393 - RNA, 27 nt, Artificial Sequence
  Synthetic oligonucleotide
caaaccugcugauucugauuauugacu

SEQ ID NO: 394 - RNA, 27 nt, Artificial Sequence
  Synthetic oligonucleotide
gcaaaccugcugauucugauuauugac

SEQ ID NO: 395 - RNA, 27 nt, Artificial Sequence
  Synthetic oligonucleotide
ugcaaaccugcugauucugauuauuga

SEQ ID NO: 396 - RNA, 27 nt, Artificial Sequence
  Synthetic oligonucleotide
cugcaaaccugcugauucugauuauug

SEQ ID NO: 397 - RNA, 27 nt, Artificial Sequence
  Synthetic oligonucleotide
acugcaaaccugcugauucugauuauu

SEQ ID NO: 398 - RNA, 27 nt, Artificial Sequence
  Synthetic oligonucleotide
gacugcaaaccugcugauucugauuau

SEQ ID NO: 399 - RNA, 27 nt, Artificial Sequence
  Synthetic oligonucleotide
ugacugcaaaccugcugauucugauua

SEQ ID NO: 400 - RNA, 27 nt, Artificial Sequence
  Synthetic oligonucleotide
ucugacugcaaaccugcugauucugau

SEQ ID NO: 401 - RNA, 27 nt, Artificial Sequence
  Synthetic oligonucleotide
aucugacugcaaaccugcugauucuga

SEQ ID NO: 402 - RNA, 27 nt, Artificial Sequence
  Synthetic oligonucleotide
caaucugacugcaaaccugcugauucu

SEQ ID NO: 403 - RNA, 27 nt, Artificial Sequence
  Synthetic oligonucleotide
ccaaucugacugcaaaccugcugauuc

SEQ ID NO: 404 - RNA, 27 nt, Artificial Sequence
  Synthetic oligonucleotide
ugcuuaucccugccaaucugacugcaa

SEQ ID NO: 405 - RNA, 27 nt, Artificial Sequence
  Synthetic oligonucleotide
uauacucacuucuccugagcuaggcug

SEQ ID NO: 406 - RNA, 27 nt, Artificial Sequence
  Synthetic oligonucleotide
uuuuauacucacuucuccugagcuagg

SEQ ID NO: 407 - RNA, 27 nt, Artificial Sequence
  Synthetic oligonucleotide
cuuuuauacucacuucuccugagcuag

SEQ ID NO: 408 - RNA, 27 nt, Artificial Sequence
  Synthetic oligonucleotide
gcuuuuauacucacuucuccugagcua

SEQ ID NO: 409 - RNA, 27 nt, Artificial Sequence
  Synthetic oligonucleotide
ggcuuuuauacucacuucuccugagcu

SEQ ID NO: 410 - RNA, 27 nt, Artificial Sequence
  Synthetic oligonucleotide
ggggcuuuuauacucacuucuccugag

SEQ ID NO: 411 - RNA, 27 nt, Artificial Sequence
  Synthetic oligonucleotide
augaguggacuucugugauggcugcuc

SEQ ID NO: 412 - RNA, 27 nt, Artificial Sequence
  Synthetic oligonucleotide
aaugaguggacuucugugauggcugcu

SEQ ID NO: 413 - RNA, 27 nt, Artificial Sequence
  Synthetic oligonucleotide
gaaugaguggacuucugugauggcugc

SEQ ID NO: 414 - RNA, 27 nt, Artificial Sequence
  Synthetic oligonucleotide
agaaugaguggacuucugugauggcug

SEQ ID NO: 415 - RNA, 27 nt, Artificial Sequence
  Synthetic oligonucleotide
aagaaugaguggacuucugugauggcu

SEQ ID NO: 416 - RNA, 27 nt, Artificial Sequence
  Synthetic oligonucleotide
caagaaugaguggacuucugugauggc

SEQ ID NO: 417 - RNA, 27 nt, Artificial Sequence
  Synthetic oligonucleotide
ccaagaaugaguggacuucugugaugg

SEQ ID NO: 418 - RNA, 27 nt, Artificial Sequence
  Synthetic oligonucleotide
ugccaagaaugaguggacuucugugau

SEQ ID NO: 419 - RNA, 27 nt, Artificial Sequence
  Synthetic oligonucleotide
cugccaagaaugaguggacuucuguga

SEQ ID NO: 420 - RNA, 27 nt, Artificial Sequence
  Synthetic oligonucleotide
cgaugagaagccauccugccaagaaug

SEQ ID NO: 421 - RNA, 27 nt, Artificial Sequence
  Synthetic oligonucleotide
acgaugagaagccauccugccaagaau

SEQ ID NO: 422 - RNA, 27 nt, Artificial Sequence
  Synthetic oligonucleotide
gacgaugagaagccauccugccaagaa

SEQ ID NO: 423 - RNA, 27 nt, Artificial Sequence
  Synthetic oligonucleotide
agacgaugagaagccauccugccaaga

SEQ ID NO: 424 - RNA, 27 nt, Artificial Sequence
  Synthetic oligonucleotide
cagacgaugagaagccauccugccaag

SEQ ID NO: 425 - RNA, 27 nt, Artificial Sequence
  Synthetic oligonucleotide
gcagacgaugagaagccauccugccaa

SEQ ID NO: 426 - RNA, 27 nt, Artificial Sequence
  Synthetic oligonucleotide
agcagacgaugagaagccauccugcca

SEQ ID NO: 427 - RNA, 27 nt, Artificial Sequence
  Synthetic oligonucleotide
gagcagacgaugagaagccauccugcc

SEQ ID NO: 428 - RNA, 27 nt, Artificial Sequence
  Synthetic oligonucleotide
ggagcagacgaugagaagccauccugc

SEQ ID NO: 429 - RNA, 27 nt, Artificial Sequence
  Synthetic oligonucleotide
aggagcagacgaugagaagccauccug

SEQ ID NO: 430 - RNA, 27 nt, Artificial Sequence
  Synthetic oligonucleotide
gaggagcagacgaugagaagccauccu

SEQ ID NO: 431 - RNA, 27 nt, Artificial Sequence
  Synthetic oligonucleotide
ggaggagcagacgaugagaagccaucc

SEQ ID NO: 432 - RNA, 27 nt, Artificial Sequence
  Synthetic oligonucleotide
aggaggagcagacgaugagaagccauc

SEQ ID NO: 433 - RNA, 27 nt, Artificial Sequence
  Synthetic oligonucleotide
gaggaggagcagacgaugagaagccau

SEQ ID NO: 434 - RNA, 27 nt, Artificial Sequence
  Synthetic oligonucleotide
agaggaggagcagacgaugagaagcca

SEQ ID NO: 435 - RNA, 27 nt, Artificial Sequence
  Synthetic oligonucleotide
cagaggaggagcagacgaugagaagcc

SEQ ID NO: 436 - RNA, 27 nt, Artificial Sequence
  Synthetic oligonucleotide
acaaauaccaguccagcaaggcagagg

SEQ ID NO: 437 - RNA, 27 nt, Artificial Sequence
  Synthetic oligonucleotide
cacaaauaccaguccagcaaggcagag

SEQ ID NO: 438 - RNA, 27 nt, Artificial Sequence
  Synthetic oligonucleotide
aucagaggacacuuggauucaccggug

SEQ ID NO: 439 - RNA, 27 nt, Artificial Sequence
  Synthetic oligonucleotide
gaccaucagaggacacuuggauucacc

SEQ ID NO: 440 - RNA, 27 nt, Artificial Sequence
  Synthetic oligonucleotide
ugaccaucagaggacacuuggauucac

SEQ ID NO: 441 - RNA, 27 nt, Artificial Sequence
  Synthetic oligonucleotide
uugaccaucagaggacacuuggauuca

SEQ ID NO: 442 - RNA, 27 nt, Artificial Sequence
  Synthetic oligonucleotide
uuugaccaucagaggacacuuggauuc

SEQ ID NO: 443 - RNA, 27 nt, Artificial Sequence
  Synthetic oligonucleotide
cuuugaccaucagaggacacuuggauu

SEQ ID NO: 444 - RNA, 27 nt, Artificial Sequence
  Synthetic oligonucleotide
acuuugaccaucagaggacacuuggau

SEQ ID NO: 445 - RNA, 27 nt, Artificial Sequence
  Synthetic oligonucleotide
aacuuugaccaucagaggacacuugga

SEQ ID NO: 446 - RNA, 27 nt, Artificial Sequence
  Synthetic oligonucleotide
gaacuuugaccaucagaggacacuugg

SEQ ID NO: 447 - RNA, 27 nt, Artificial Sequence
  Synthetic oligonucleotide
agaacuuugaccaucagaggacacuug

SEQ ID NO: 448 - RNA, 27 nt, Artificial Sequence
  Synthetic oligonucleotide
uagaacuuugaccaucagaggacacuu

SEQ ID NO: 449 - RNA, 27 nt, Artificial Sequence
  Synthetic oligonucleotide
cuagaacuuugaccaucagaggacacu

SEQ ID NO: 450 - RNA, 27 nt, Artificial Sequence
  Synthetic oligonucleotide
ucuagaacuuugaccaucagaggacac

SEQ ID NO: 451 - RNA, 27 nt, Artificial Sequence
  Synthetic oligonucleotide
aucuagaacuuugaccaucagaggaca

SEQ ID NO: 452 - RNA, 27 nt, Artificial Sequence
  Synthetic oligonucleotide
caucuagaacuuugaccaucagaggac

SEQ ID NO: 453 - RNA, 27 nt, Artificial Sequence
  Synthetic oligonucleotide
gcaucuagaacuuugaccaucagagga

SEQ ID NO: 454 - RNA, 27 nt, Artificial Sequence
  Synthetic oligonucleotide
agcaucuagaacuuugaccaucagagg

SEQ ID NO: 455 - RNA, 27 nt, Artificial Sequence
  Synthetic oligonucleotide
cagcaucuagaacuuugaccaucagag

SEQ ID NO: 456 - RNA, 27 nt, Artificial Sequence
  Synthetic oligonucleotide
acagcaucuagaacuuugaccaucaga

SEQ ID NO: 457 - RNA, 27 nt, Artificial Sequence
  Synthetic oligonucleotide
gacagcaucuagaacuuugaccaucag

SEQ ID NO: 458 - RNA, 27 nt, Artificial Sequence
  Synthetic oligonucleotide
ggacagcaucuagaacuuugaccauca

SEQ ID NO: 459 - RNA, 27 nt, Artificial Sequence
  Synthetic oligonucleotide
cggacagcaucuagaacuuugaccauc

SEQ ID NO: 460 - RNA, 27 nt, Artificial Sequence
  Synthetic oligonucleotide
acugguuuucccagaggcaaauggcuc

SEQ ID NO: 461 - RNA, 27 nt, Artificial Sequence
  Synthetic oligonucleotide
cacugguuuucccagaggcaaauggcu

SEQ ID NO: 462 - RNA, 27 nt, Artificial Sequence
  Synthetic oligonucleotide
ucacugguuuucccagaggcaaauggc

SEQ ID NO: 463 - RNA, 27 nt, Artificial Sequence
  Synthetic oligonucleotide
cucacugguuuucccagaggcaaaugg

SEQ ID NO: 464 - RNA, 27 nt, Artificial Sequence
  Synthetic oligonucleotide
acucacugguuuucccagaggcaaaug

SEQ ID NO: 465 - RNA, 27 nt, Artificial Sequence
  Synthetic oligonucleotide
gacucacugguuuucccagaggcaaau

SEQ ID NO: 466 - RNA, 27 nt, Artificial Sequence
  Synthetic oligonucleotide
agacucacugguuuucccagaggcaaa

SEQ ID NO: 467 - RNA, 27 nt, Artificial Sequence
  Synthetic oligonucleotide
cagacucacugguuuucccagaggcaa

SEQ ID NO: 468 - RNA, 27 nt, Artificial Sequence
  Synthetic oligonucleotide
ccagacucacugguuuucccagaggca

SEQ ID NO: 469 - RNA, 27 nt, Artificial Sequence
  Synthetic oligonucleotide
uccagacucacugguuuucccagaggc

SEQ ID NO: 470 - RNA, 27 nt, Artificial Sequence
  Synthetic oligonucleotide
cuccagacucacugguuuucccagagg

SEQ ID NO: 471 - RNA, 27 nt, Artificial Sequence
  Synthetic oligonucleotide
ucuccagacucacugguuuucccagag

SEQ ID NO: 472 - RNA, 27 nt, Artificial Sequence
  Synthetic oligonucleotide
cucuccagacucacugguuuucccaga

SEQ ID NO: 473 - RNA, 27 nt, Artificial Sequence
  Synthetic oligonucleotide
gcucuccagacucacugguuuucccag

SEQ ID NO: 474 - RNA, 27 nt, Artificial Sequence
  Synthetic oligonucleotide
agcucuccagacucacugguuuuccca

SEQ ID NO: 475 - RNA, 27 nt, Artificial Sequence
  Synthetic oligonucleotide
cagcucuccagacucacugguuuuccc

SEQ ID NO: 476 - RNA, 27 nt, Artificial Sequence
  Synthetic oligonucleotide
uccucaguugugagcccaugcagcucu

SEQ ID NO: 477 - RNA, 27 nt, Artificial Sequence
  Synthetic oligonucleotide
cuccucaguugugagcccaugcagcuc

SEQ ID NO: 478 - RNA, 27 nt, Artificial Sequence
  Synthetic oligonucleotide
ccuccucaguugugagcccaugcagcu

SEQ ID NO: 479 - RNA, 27 nt, Artificial Sequence
  Synthetic oligonucleotide
uccuccucaguugugagcccaugcagc

SEQ ID NO: 480 - RNA, 27 nt, Artificial Sequence
  Synthetic oligonucleotide
uuccuccucaguugugagcccaugcag

SEQ ID NO: 481 - RNA, 27 nt, Artificial Sequence
  Synthetic oligonucleotide
auuccuccucaguugugagcccaugca

SEQ ID NO: 482 - RNA, 27 nt, Artificial Sequence
  Synthetic oligonucleotide
aauuccuccucaguugugagcccaugc

SEQ ID NO: 483 - RNA, 27 nt, Artificial Sequence
  Synthetic oligonucleotide
aaauuccuccucaguugugagcccaug

SEQ ID NO: 484 - RNA, 27 nt, Artificial Sequence
  Synthetic oligonucleotide
caaauuccuccucaguugugagcccau

SEQ ID NO: 485 - RNA, 27 nt, Artificial Sequence
  Synthetic oligonucleotide
acaaauuccuccucaguugugagccca

SEQ ID NO: 486 - RNA, 27 nt, Artificial Sequence
  Synthetic oligonucleotide
uacaaauuccuccucaguugugagccc

SEQ ID NO: 487 - RNA, 27 nt, Artificial Sequence
  Synthetic oligonucleotide
cuacaaauuccuccucaguugugagcc

SEQ ID NO: 488 - RNA, 27 nt, Artificial Sequence
  Synthetic oligonucleotide
ucuacaaauuccuccucaguugugagc

SEQ ID NO: 489 - RNA, 27 nt, Artificial Sequence
  Synthetic oligonucleotide
uucuacaaauuccuccucaguugugag

SEQ ID NO: 490 - RNA, 27 nt, Artificial Sequence
  Synthetic oligonucleotide
cuucuacaaauuccuccucaguuguga

SEQ ID NO: 491 - RNA, 27 nt, Artificial Sequence
  Synthetic oligonucleotide
ccuucuacaaauuccuccucaguugug

SEQ ID NO: 492 - RNA, 27 nt, Artificial Sequence
  Synthetic oligonucleotide
ucccuucuacaaauuccuccucaguug

SEQ ID NO: 493 - RNA, 27 nt, Artificial Sequence
  Synthetic oligonucleotide
aucccuucuacaaauuccuccucaguu

SEQ ID NO: 494 - RNA, 27 nt, Artificial Sequence
  Synthetic oligonucleotide
uaucccuucuacaaauuccuccucagu

SEQ ID NO: 495 - RNA, 27 nt, Artificial Sequence
  Synthetic oligonucleotide
auaucccuucuacaaauuccuccucag

SEQ ID NO: 496 - RNA, 27 nt, Artificial Sequence
  Synthetic oligonucleotide
uauaucccuucuacaaauuccuccuca

SEQ ID NO: 497 - RNA, 27 nt, Artificial Sequence
  Synthetic oligonucleotide
guauaucccuucuacaaauuccuccuc

SEQ ID NO: 498 - RNA, 27 nt, Artificial Sequence
  Synthetic oligonucleotide
uguauaucccuucuacaaauuccuccu

SEQ ID NO: 499 - RNA, 27 nt, Artificial Sequence
  Synthetic oligonucleotide
uuguauaucccuucuacaaauuccucc

SEQ ID NO: 500 - RNA, 27 nt, Artificial Sequence
  Synthetic oligonucleotide
uuuguauaucccuucuacaaauuccuc

SEQ ID NO: 501 - RNA, 27 nt, Artificial Sequence
  Synthetic oligonucleotide
cuuuguauaucccuucuacaaauuccu

SEQ ID NO: 502 - RNA, 27 nt, Artificial Sequence
  Synthetic oligonucleotide
acuuuguauaucccuucuacaaauucc

SEQ ID NO: 503 - RNA, 27 nt, Artificial Sequence
  Synthetic oligonucleotide
cacuuuguauaucccuucuacaaauuc

SEQ ID NO: 504 - RNA, 27 nt, Artificial Sequence
  Synthetic oligonucleotide
ccacuuuguauaucccuucuacaaauu

SEQ ID NO: 505 - RNA, 27 nt, Artificial Sequence
  Synthetic oligonucleotide
uccacuuuguauaucccuucuacaaau

SEQ ID NO: 506 - RNA, 27 nt, Artificial Sequence
  Synthetic oligonucleotide
uuccacuuuguauaucccuucuacaaa

SEQ ID NO: 507 - RNA, 27 nt, Artificial Sequence
  Synthetic oligonucleotide
uuuccacuuuguauaucccuucuacaa

SEQ ID NO: 508 - RNA, 27 nt, Artificial Sequence
  Synthetic oligonucleotide
auuuccacuuuguauaucccuucuaca

SEQ ID NO: 509 - RNA, 27 nt, Artificial Sequence
  Synthetic oligonucleotide
uauuuccacuuuguauaucccuucuac

SEQ ID NO: 510 - RNA, 27 nt, Artificial Sequence
  Synthetic oligonucleotide
cuauuuccacuuuguauaucccuucua

SEQ ID NO: 511 - RNA, 27 nt, Artificial Sequence
  Synthetic oligonucleotide
ucuauuuccacuuuguauaucccuucu

SEQ ID NO: 512 - RNA, 27 nt, Artificial Sequence
  Synthetic oligonucleotide
gucuauuuccacuuuguauaucccuuc

SEQ ID NO: 513 - RNA, 27 nt, Artificial Sequence
  Synthetic oligonucleotide
ugucuauuuccacuuuguauaucccuu

SEQ ID NO: 514 - RNA, 27 nt, Artificial Sequence
  Synthetic oligonucleotide
gugucuauuuccacuuuguauaucccu

SEQ ID NO: 515 - RNA, 27 nt, Artificial Sequence
  Synthetic oligonucleotide
ggugucuauuuccacuuuguauauccc

SEQ ID NO: 516 - RNA, 27 nt, Artificial Sequence
  Synthetic oligonucleotide
uggugucuauuuccacuuuguauaucc

SEQ ID NO: 517 - RNA, 27 nt, Artificial Sequence
  Synthetic oligonucleotide
uuggugucuauuuccacuuuguauauc

SEQ ID NO: 518 - RNA, 27 nt, Artificial Sequence
  Synthetic oligonucleotide
uuuggugucuauuuccacuuuguauau

SEQ ID NO: 519 - RNA, 27 nt, Artificial Sequence
  Synthetic oligonucleotide
auuuggugucuauuuccacuuuguaua

SEQ ID NO: 520 - RNA, 27 nt, Artificial Sequence
  Synthetic oligonucleotide
gauuuggugucuauuuccacuuuguau

SEQ ID NO: 521 - RNA, 27 nt, Artificial Sequence
  Synthetic oligonucleotide
agauuuggugucuauuuccacuuugua

SEQ ID NO: 522 - RNA, 27 nt, Artificial Sequence
  Synthetic oligonucleotide
aagauuuggugucuauuuccacuuugu

SEQ ID NO: 523 - RNA, 27 nt, Artificial Sequence
  Synthetic oligonucleotide
uaagauuuggugucuauuuccacuuug

SEQ ID NO: 524 - RNA, 27 nt, Artificial Sequence
  Synthetic oligonucleotide
guaagauuuggugucuauuuccacuuu

SEQ ID NO: 525 - RNA, 27 nt, Artificial Sequence
  Synthetic oligonucleotide
aguaagauuuggugucuauuuccacuu

SEQ ID NO: 526 - RNA, 27 nt, Artificial Sequence
  Synthetic oligonucleotide
caguaagauuuggugucuauuuccacu

SEQ ID NO: 527 - RNA, 27 nt, Artificial Sequence
  Synthetic oligonucleotide
ccaguaagauuuggugucuauuuccac

SEQ ID NO: 528 - RNA, 27 nt, Artificial Sequence
  Synthetic oligonucleotide
uccaguaagauuuggugucuauuucca

SEQ ID NO: 529 - RNA, 27 nt, Artificial Sequence
  Synthetic oligonucleotide
uuccaguaagauuuggugucuauuucc

SEQ ID NO: 530 - RNA, 27 nt, Artificial Sequence
  Synthetic oligonucleotide
cuuccaguaagauuuggugucuauuuc

SEQ ID NO: 531 - RNA, 27 nt, Artificial Sequence
  Synthetic oligonucleotide
ccuuccaguaagauuuggugucuauuu

SEQ ID NO: 532 - RNA, 27 nt, Artificial Sequence
  Synthetic oligonucleotide
ugccuuccaguaagauuuggugucuau

SEQ ID NO: 533 - RNA, 27 nt, Artificial Sequence
  Synthetic oligonucleotide
gugccuuccaguaagauuuggugucua

SEQ ID NO: 534 - RNA, 27 nt, Artificial Sequence
  Synthetic oligonucleotide
ucauggaauggggagaugccaagugcc

SEQ ID NO: 535 - RNA, 27 nt, Artificial Sequence
  Synthetic oligonucleotide
cucauggaauggggagaugccaagugc

SEQ ID NO: 536 - RNA, 27 nt, Artificial Sequence
  Synthetic oligonucleotide
gcucauggaauggggagaugccaagug

SEQ ID NO: 537 - RNA, 27 nt, Artificial Sequence
  Synthetic oligonucleotide
ugcucauggaauggggagaugccaagu

SEQ ID NO: 538 - RNA, 27 nt, Artificial Sequence
  Synthetic oligonucleotide
augcucauggaauggggagaugccaag

SEQ ID NO: 539 - RNA, 27 nt, Artificial Sequence
  Synthetic oligonucleotide
caugcucauggaauggggagaugccaa

SEQ ID NO: 540 - RNA, 27 nt, Artificial Sequence
  Synthetic oligonucleotide
gcaugcucauggaauggggagaugcca

SEQ ID NO: 541 - RNA, 27 nt, Artificial Sequence
  Synthetic oligonucleotide
ugcaugcucauggaauggggagaugcc

SEQ ID NO: 542 - RNA, 27 nt, Artificial Sequence
  Synthetic oligonucleotide
cugcaugcucauggaauggggagaugc

SEQ ID NO: 543 - RNA, 27 nt, Artificial Sequence
  Synthetic oligonucleotide
ucugcaugcucauggaauggggagaug

SEQ ID NO: 544 - RNA, 27 nt, Artificial Sequence
  Synthetic oligonucleotide
cucugcaugcucauggaauggggagau

SEQ ID NO: 545 - RNA, 27 nt, Artificial Sequence
  Synthetic oligonucleotide
ccucugcaugcucauggaauggggaga

SEQ ID NO: 546 - RNA, 27 nt, Artificial Sequence
  Synthetic oligonucleotide
accucugcaugcucauggaauggggag

SEQ ID NO: 547 - RNA, 27 nt, Artificial Sequence
  Synthetic oligonucleotide
ugaauaccaccucugcaugcucaugga

SEQ ID NO: 548 - RNA, 27 nt, Artificial Sequence
  Synthetic oligonucleotide
gugaauaccaccucugcaugcucaugg

SEQ ID NO: 549 - RNA, 27 nt, Artificial Sequence
  Synthetic oligonucleotide
ugugaauaccaccucugcaugcucaug

SEQ ID NO: 550 - RNA, 27 nt, Artificial Sequence
  Synthetic oligonucleotide
cugugaauaccaccucugcaugcucau

SEQ ID NO: 551 - RNA, 27 nt, Artificial Sequence
  Synthetic oligonucleotide
uuggcugugaauaccaccucugcaugc

SEQ ID NO: 552 - RNA, 27 nt, Artificial Sequence
  Synthetic oligonucleotide
gucguuggcugugaauaccaccucugc

SEQ ID NO: 553 - RNA, 27 nt, Artificial Sequence
  Synthetic oligonucleotide
agucguuggcugugaauaccaccucug

SEQ ID NO: 554 - RNA, 27 nt, Artificial Sequence
  Synthetic oligonucleotide
cucauuccuugggauuggugacgacag

SEQ ID NO: 555 - RNA, 27 nt, Artificial Sequence
  Synthetic oligonucleotide
uuacaugaaaucccaucccucguccuu

SEQ ID NO: 556 - RNA, 27 nt, Artificial Sequence
  Synthetic oligonucleotide
guuacaugaaaucccaucccucguccu

SEQ ID NO: 557 - RNA, 27 nt, Artificial Sequence
  Synthetic oligonucleotide
uugguuacaugaaaucccaucccucgu

SEQ ID NO: 558 - RNA, 27 nt, Artificial Sequence
  Synthetic oligonucleotide
cuugguuacaugaaaucccaucccucg

SEQ ID NO: 559 - RNA, 27 nt, Artificial Sequence
  Synthetic oligonucleotide
ucuugguuacaugaaaucccaucccuc

SEQ ID NO: 560 - RNA, 27 nt, Artificial Sequence
  Synthetic oligonucleotide
acucuugguuacaugaaaucccauccc

SEQ ID NO: 561 - RNA, 27 nt, Artificial Sequence
  Synthetic oligonucleotide
uacucuugguuacaugaaaucccaucc

SEQ ID NO: 562 - RNA, 27 nt, Artificial Sequence
  Synthetic oligonucleotide
auacucuugguuacaugaaaucccauc

SEQ ID NO: 563 - RNA, 27 nt, Artificial Sequence
  Synthetic oligonucleotide
aauacucuugguuacaugaaaucccau

SEQ ID NO: 564 - RNA, 27 nt, Artificial Sequence
  Synthetic oligonucleotide
gaauacucuugguuacaugaaauccca

SEQ ID NO: 565 - RNA, 27 nt, Artificial Sequence
  Synthetic oligonucleotide
ggaauacucuugguuacaugaaauccc

SEQ ID NO: 566 - RNA, 27 nt, Artificial Sequence
  Synthetic oligonucleotide
uggaauacucuugguuacaugaaaucc

SEQ ID NO: 567 - RNA, 27 nt, Artificial Sequence
  Synthetic oligonucleotide
auggaauacucuugguuacaugaaauc

SEQ ID NO: 568 - RNA, 27 nt, Artificial Sequence
  Synthetic oligonucleotide
aauggaauacucuugguuacaugaaau

SEQ ID NO: 569 - RNA, 27 nt, Artificial Sequence
  Synthetic oligonucleotide
aaauggaauacucuugguuacaugaaa

SEQ ID NO: 570 - RNA, 27 nt, Artificial Sequence
  Synthetic oligonucleotide
aaaauggaauacucuugguuacaugaa

SEQ ID NO: 571 - RNA, 27 nt, Artificial Sequence
  Synthetic oligonucleotide
aaaaauggaauacucuugguuacauga

SEQ ID NO: 572 - RNA, 27 nt, Artificial Sequence
  Synthetic oligonucleotide
uaaaaauggaauacucuugguuacaug

SEQ ID NO: 573 - RNA, 27 nt, Artificial Sequence
  Synthetic oligonucleotide
guaaaaauggaauacucuugguuacau

SEQ ID NO: 574 - RNA, 27 nt, Artificial Sequence
  Synthetic oligonucleotide
aguaaaaauggaauacucuugguuaca

SEQ ID NO: 575 - RNA, 27 nt, Artificial Sequence
  Synthetic oligonucleotide
uaguaaaaauggaauacucuugguuac

SEQ ID NO: 576 - RNA, 27 nt, Artificial Sequence
  Synthetic oligonucleotide
uuaguaaaaauggaauacucuugguua

SEQ ID NO: 577 - RNA, 27 nt, Artificial Sequence
  Synthetic oligonucleotide
uuuaguaaaaauggaauacucuugguu

SEQ ID NO: 578 - RNA, 27 nt, Artificial Sequence
  Synthetic oligonucleotide
cuuuaguaaaaauggaauacucuuggu

SEQ ID NO: 579 - RNA, 27 nt, Artificial Sequence
  Synthetic oligonucleotide
gcuuuaguaaaaauggaauacucuugg

SEQ ID NO: 580 - RNA, 27 nt, Artificial Sequence
  Synthetic oligonucleotide
ugcuuuaguaaaaauggaauacucuug

SEQ ID NO: 581 - RNA, 27 nt, Artificial Sequence
  Synthetic oligonucleotide
cugcuuuaguaaaaauggaauacucuu

SEQ ID NO: 582 - RNA, 27 nt, Artificial Sequence
  Synthetic oligonucleotide
acugcuuuaguaaaaauggaauacucu

SEQ ID NO: 583 - RNA, 27 nt, Artificial Sequence
  Synthetic oligonucleotide
cacugcuuuaguaaaaauggaauacuc

SEQ ID NO: 584 - RNA, 27 nt, Artificial Sequence
  Synthetic oligonucleotide
acacugcuuuaguaaaaauggaauacu

SEQ ID NO: 585 - RNA, 27 nt, Artificial Sequence
  Synthetic oligonucleotide
aacacugcuuuaguaaaaauggaauac

SEQ ID NO: 586 - RNA, 27 nt, Artificial Sequence
  Synthetic oligonucleotide
aaacacugcuuuaguaaaaauggaaua

SEQ ID NO: 587 - RNA, 27 nt, Artificial Sequence
  Synthetic oligonucleotide
aaaacacugcuuuaguaaaaauggaau

SEQ ID NO: 588 - RNA, 27 nt, Artificial Sequence
  Synthetic oligonucleotide
gaaaacacugcuuuaguaaaaauggaa

SEQ ID NO: 589 - RNA, 27 nt, Artificial Sequence
  Synthetic oligonucleotide
ugaaaacacugcuuuaguaaaaaugga

SEQ ID NO: 590 - RNA, 27 nt, Artificial Sequence
  Synthetic oligonucleotide
gugaaaacacugcuuuaguaaaaaugg

SEQ ID NO: 591 - RNA, 27 nt, Artificial Sequence
  Synthetic oligonucleotide
ggugaaaacacugcuuuaguaaaaaug

SEQ ID NO: 592 - RNA, 27 nt, Artificial Sequence
  Synthetic oligonucleotide
aggugaaaacacugcuuuaguaaaaau

SEQ ID NO: 593 - RNA, 27 nt, Artificial Sequence
  Synthetic oligonucleotide
gaggugaaaacacugcuuuaguaaaaa

SEQ ID NO: 594 - RNA, 27 nt, Artificial Sequence
  Synthetic oligonucleotide
ugaggugaaaacacugcuuuaguaaaa

SEQ ID NO: 595 - RNA, 27 nt, Artificial Sequence
  Synthetic oligonucleotide
augaggugaaaacacugcuuuaguaaa

SEQ ID NO: 596 - RNA, 27 nt, Artificial Sequence
  Synthetic oligonucleotide
uaugaggugaaaacacugcuuuaguaa

SEQ ID NO: 597 - RNA, 27 nt, Artificial Sequence
  Synthetic oligonucleotide
auaugaggugaaaacacugcuuuagua

SEQ ID NO: 598 - RNA, 27 nt, Artificial Sequence
  Synthetic oligonucleotide
cauaugaggugaaaacacugcuuuagu

SEQ ID NO: 599 - RNA, 27 nt, Artificial Sequence
  Synthetic oligonucleotide
gcauaugaggugaaaacacugcuuuag

SEQ ID NO: 600 - RNA, 27 nt, Artificial Sequence
  Synthetic oligonucleotide
agcauaugaggugaaaacacugcuuua

SEQ ID NO: 601 - RNA, 27 nt, Artificial Sequence
  Synthetic oligonucleotide
uagcauaugaggugaaaacacugcuuu

SEQ ID NO: 602 - RNA, 27 nt, Artificial Sequence
  Synthetic oligonucleotide
auagcauaugaggugaaaacacugcuu

SEQ ID NO: 603 - RNA, 27 nt, Artificial Sequence
  Synthetic oligonucleotide
cauagcauaugaggugaaaacacugcu

SEQ ID NO: 604 - RNA, 27 nt, Artificial Sequence
  Synthetic oligonucleotide
acauagcauaugaggugaaaacacugc

SEQ ID NO: 605 - RNA, 27 nt, Artificial Sequence
  Synthetic oligonucleotide
aacauagcauaugaggugaaaacacug

SEQ ID NO: 606 - RNA, 27 nt, Artificial Sequence
  Synthetic oligonucleotide
uaacauagcauaugaggugaaaacacu

SEQ ID NO: 607 - RNA, 27 nt, Artificial Sequence
  Synthetic oligonucleotide
cuaacauagcauaugaggugaaaacac

SEQ ID NO: 608 - RNA, 27 nt, Artificial Sequence
  Synthetic oligonucleotide
ucuaacauagcauaugaggugaaaaca

SEQ ID NO: 609 - RNA, 27 nt, Artificial Sequence
  Synthetic oligonucleotide
uucuaacauagcauaugaggugaaaac

SEQ ID NO: 610 - RNA, 27 nt, Artificial Sequence
  Synthetic oligonucleotide
cuucuaacauagcauaugaggugaaaa

SEQ ID NO: 611 - RNA, 27 nt, Artificial Sequence
  Synthetic oligonucleotide
acuucuaacauagcauaugaggugaaa

SEQ ID NO: 612 - RNA, 27 nt, Artificial Sequence
  Synthetic oligonucleotide
gacuucuaacauagcauaugaggugaa

SEQ ID NO: 613 - RNA, 27 nt, Artificial Sequence
  Synthetic oligonucleotide
ggacuucuaacauagcauaugagguga

SEQ ID NO: 614 - RNA, 27 nt, Artificial Sequence
  Synthetic oligonucleotide
uggacuucuaacauagcauaugaggug

SEQ ID NO: 615 - RNA, 27 nt, Artificial Sequence
  Synthetic oligonucleotide
cuggacuucuaacauagcauaugaggu

SEQ ID NO: 616 - RNA, 27 nt, Artificial Sequence
  Synthetic oligonucleotide
ccuggacuucuaacauagcauaugagg

SEQ ID NO: 617 - RNA, 27 nt, Artificial Sequence
  Synthetic oligonucleotide
gccuggacuucuaacauagcauaugag

SEQ ID NO: 618 - RNA, 27 nt, Artificial Sequence
  Synthetic oligonucleotide
ugccuggacuucuaacauagcauauga

SEQ ID NO: 619 - RNA, 27 nt, Artificial Sequence
  Synthetic oligonucleotide
cugccuggacuucuaacauagcauaug

SEQ ID NO: 620 - RNA, 27 nt, Artificial Sequence
  Synthetic oligonucleotide
ucugccuggacuucuaacauagcauau

SEQ ID NO: 621 - RNA, 27 nt, Artificial Sequence
  Synthetic oligonucleotide
gucucugccuggacuucuaacauagca

SEQ ID NO: 622 - RNA, 27 nt, Artificial Sequence
  Synthetic oligonucleotide
uugucucugccuggacuucuaacauag

SEQ ID NO: 623 - RNA, 27 nt, Artificial Sequence
  Synthetic oligonucleotide
auugucucugccuggacuucuaacaua

SEQ ID NO: 624 - RNA, 27 nt, Artificial Sequence
  Synthetic oligonucleotide
uauugucucugccuggacuucuaacau

SEQ ID NO: 625 - RNA, 27 nt, Artificial Sequence
  Synthetic oligonucleotide
uuauugucucugccuggacuucuaaca

SEQ ID NO: 626 - RNA, 27 nt, Artificial Sequence
  Synthetic oligonucleotide
uuuauugucucugccuggacuucuaac

SEQ ID NO: 627 - RNA, 27 nt, Artificial Sequence
  Synthetic oligonucleotide
uuuuauugucucugccuggacuucuaa

SEQ ID NO: 628 - RNA, 27 nt, Artificial Sequence
  Synthetic oligonucleotide
guuuuauugucucugccuggacuucua

SEQ ID NO: 629 - RNA, 27 nt, Artificial Sequence
  Synthetic oligonucleotide
uguuuuauugucucugccuggacuucu

SEQ ID NO: 630 - RNA, 27 nt, Artificial Sequence
  Synthetic oligonucleotide
auguuuuauugucucugccuggacuuc

SEQ ID NO: 631 - RNA, 27 nt, Artificial Sequence
  Synthetic oligonucleotide
aauguuuuauugucucugccuggacuu

SEQ ID NO: 632 - RNA, 27 nt, Artificial Sequence
  Synthetic oligonucleotide
gaauguuuuauugucucugccuggacu

SEQ ID NO: 633 - RNA, 27 nt, Artificial Sequence
  Synthetic oligonucleotide
aggaauguuuuauugucucugccugga

SEQ ID NO: 634 - RNA, 27 nt, Artificial Sequence
  Synthetic oligonucleotide
caggaauguuuuauugucucugccugg

SEQ ID NO: 635 - RNA, 27 nt, Artificial Sequence
  Synthetic oligonucleotide
acaggaauguuuuauugucucugccug

SEQ ID NO: 636 - RNA, 27 nt, Artificial Sequence
  Synthetic oligonucleotide
cacaggaauguuuuauugucucugccu

SEQ ID NO: 637 - RNA, 27 nt, Artificial Sequence
  Synthetic oligonucleotide
ucacaggaauguuuuauugucucugcc

SEQ ID NO: 638 - RNA, 27 nt, Artificial Sequence
  Synthetic oligonucleotide
uucacaggaauguuuuauugucucugc

SEQ ID NO: 639 - RNA, 27 nt, Artificial Sequence
  Synthetic oligonucleotide
uuucacaggaauguuuuauugucucug

SEQ ID NO: 640 - RNA, 27 nt, Artificial Sequence
  Synthetic oligonucleotide
cuuucacaggaauguuuuauugucucu

SEQ ID NO: 641 - RNA, 27 nt, Artificial Sequence
  Synthetic oligonucleotide
ccuuucacaggaauguuuuauugucuc

SEQ ID NO: 642 - RNA, 27 nt, Artificial Sequence
  Synthetic oligonucleotide
gccuuucacaggaauguuuuauugucu

SEQ ID NO: 643 - RNA, 27 nt, Artificial Sequence
  Synthetic oligonucleotide
ugccuuucacaggaauguuuuauuguc

SEQ ID NO: 644 - RNA, 27 nt, Artificial Sequence
  Synthetic oligonucleotide
gugccuuucacaggaauguuuuauugu

SEQ ID NO: 645 - RNA, 27 nt, Artificial Sequence
  Synthetic oligonucleotide
agugccuuucacaggaauguuuuauug

SEQ ID NO: 646 - RNA, 27 nt, Artificial Sequence
  Synthetic oligonucleotide
aaaagugccuuucacaggaauguuuua

SEQ ID NO: 647 - RNA, 27 nt, Artificial Sequence
  Synthetic oligonucleotide
gaaaagugccuuucacaggaauguuuu

SEQ ID NO: 648 - RNA, 27 nt, Artificial Sequence
  Synthetic oligonucleotide
ugaaaagugccuuucacaggaauguuu

SEQ ID NO: 649 - RNA, 27 nt, Artificial Sequence
  Synthetic oligonucleotide
augaaaagugccuuucacaggaauguu

SEQ ID NO: 650 - RNA, 27 nt, Artificial Sequence
  Synthetic oligonucleotide
aaugaaaagugccuuucacaggaaugu

SEQ ID NO: 651 - RNA, 27 nt, Artificial Sequence
  Synthetic oligonucleotide
gaaugaaaagugccuuucacaggaaug

SEQ ID NO: 652 - RNA, 27 nt, Artificial Sequence
  Synthetic oligonucleotide
uggaaugaaaagugccuuucacaggaa

SEQ ID NO: 653 - RNA, 27 nt, Artificial Sequence
  Synthetic oligonucleotide
guggaaugaaaagugccuuucacagga

SEQ ID NO: 654 - RNA, 27 nt, Artificial Sequence
  Synthetic oligonucleotide
aguggaaugaaaagugccuuucacagg

SEQ ID NO: 655 - RNA, 27 nt, Artificial Sequence
  Synthetic oligonucleotide
aaguggaaugaaaagugccuuucacag

SEQ ID NO: 656 - RNA, 27 nt, Artificial Sequence
  Synthetic oligonucleotide
aaaguggaaugaaaagugccuuucaca

SEQ ID NO: 657 - RNA, 27 nt, Artificial Sequence
  Synthetic oligonucleotide
uaaaguggaaugaaaagugccuuucac

SEQ ID NO: 658 - RNA, 27 nt, Artificial Sequence
  Synthetic oligonucleotide
uuaaaguggaaugaaaagugccuuuca

SEQ ID NO: 659 - RNA, 27 nt, Artificial Sequence
  Synthetic oligonucleotide
guuaaaguggaaugaaaagugccuuuc

SEQ ID NO: 660 - RNA, 27 nt, Artificial Sequence
  Synthetic oligonucleotide
aguuaaaguggaaugaaaagugccuuu

SEQ ID NO: 661 - RNA, 27 nt, Artificial Sequence
  Synthetic oligonucleotide
aaguuaaaguggaaugaaaagugccuu

SEQ ID NO: 662 - RNA, 27 nt, Artificial Sequence
  Synthetic oligonucleotide
caaguuaaaguggaaugaaaagugccu

SEQ ID NO: 663 - RNA, 27 nt, Artificial Sequence
  Synthetic oligonucleotide
ucaaguuaaaguggaaugaaaagugcc

SEQ ID NO: 664 - RNA, 27 nt, Artificial Sequence
  Synthetic oligonucleotide
aucaaguuaaaguggaaugaaaagugc

SEQ ID NO: 665 - RNA, 27 nt, Artificial Sequence
  Synthetic oligonucleotide
aaucaaguuaaaguggaaugaaaagug

SEQ ID NO: 666 - RNA, 27 nt, Artificial Sequence
  Synthetic oligonucleotide
aaaucaaguuaaaguggaaugaaaagu

SEQ ID NO: 667 - RNA, 27 nt, Artificial Sequence
  Synthetic oligonucleotide
aaaaucaaguuaaaguggaaugaaaag

SEQ ID NO: 668 - RNA, 27 nt, Artificial Sequence
  Synthetic oligonucleotide
aaaaaucaaguuaaaguggaaugaaaa

SEQ ID NO: 669 - RNA, 27 nt, Artificial Sequence
  Synthetic oligonucleotide
aaaaaaucaaguuaaaguggaaugaaa

SEQ ID NO: 670 - RNA, 27 nt, Artificial Sequence
  Synthetic oligonucleotide
uaaaaaaucaaguuaaaguggaaugaa

SEQ ID NO: 671 - RNA, 27 nt, Artificial Sequence
  Synthetic oligonucleotide
uuaaaaaaucaaguuaaaguggaauga

SEQ ID NO: 672 - RNA, 27 nt, Artificial Sequence
  Synthetic oligonucleotide
uuuaaaaaaucaaguuaaaguggaaug

SEQ ID NO: 673 - RNA, 27 nt, Artificial Sequence
  Synthetic oligonucleotide
auuuaaaaaaucaaguuaaaguggaau

SEQ ID NO: 674 - RNA, 27 nt, Artificial Sequence
  Synthetic oligonucleotide
aauuuaaaaaaucaaguuaaaguggaa

SEQ ID NO: 675 - RNA, 27 nt, Artificial Sequence
  Synthetic oligonucleotide
gaauuuaaaaaaucaaguuaaagugga

SEQ ID NO: 676 - RNA, 27 nt, Artificial Sequence
  Synthetic oligonucleotide
ggaauuuaaaaaaucaaguuaaagugg

SEQ ID NO: 677 - RNA, 27 nt, Artificial Sequence
  Synthetic oligonucleotide
gggaauuuaaaaaaucaaguuaaagug

SEQ ID NO: 678 - RNA, 27 nt, Artificial Sequence
  Synthetic oligonucleotide
agggaauuuaaaaaaucaaguuaaagu

SEQ ID NO: 679 - RNA, 27 nt, Artificial Sequence
  Synthetic oligonucleotide
aagggaauuuaaaaaaucaaguuaaag

SEQ ID NO: 680 - RNA, 27 nt, Artificial Sequence
  Synthetic oligonucleotide
uaagggaauuuaaaaaaucaaguuaaa

SEQ ID NO: 681 - RNA, 27 nt, Artificial Sequence
  Synthetic oligonucleotide
auaagggaauuuaaaaaaucaaguuaa

SEQ ID NO: 682 - RNA, 27 nt, Artificial Sequence
  Synthetic oligonucleotide
aauaagggaauuuaaaaaaucaaguua

SEQ ID NO: 683 - RNA, 27 nt, Artificial Sequence
  Synthetic oligonucleotide
caauaagggaauuuaaaaaaucaaguu

SEQ ID NO: 684 - RNA, 27 nt, Artificial Sequence
  Synthetic oligonucleotide
acaauaagggaauuuaaaaaaucaagu

SEQ ID NO: 685 - RNA, 27 nt, Artificial Sequence
  Synthetic oligonucleotide
gacaauaagggaauuuaaaaaaucaag

SEQ ID NO: 686 - RNA, 27 nt, Artificial Sequence
  Synthetic oligonucleotide
ggacaauaagggaauuuaaaaaaucaa

SEQ ID NO: 687 - RNA, 27 nt, Artificial Sequence
  Synthetic oligonucleotide
gggacaauaagggaauuuaaaaaauca

SEQ ID NO: 688 - RNA, 27 nt, Artificial Sequence
  Synthetic oligonucleotide
aagggacaauaagggaauuuaaaaaau

SEQ ID NO: 689 - RNA, 27 nt, Artificial Sequence
  Synthetic oligonucleotide
uuuggaagggacaauaagggaauuuaa

SEQ ID NO: 690 - RNA, 27 nt, Artificial Sequence
  Synthetic oligonucleotide
uuuuggaagggacaauaagggaauuua

SEQ ID NO: 691 - RNA, 27 nt, Artificial Sequence
  Synthetic oligonucleotide
uuuuuuuggaagggacaauaagggaau

SEQ ID NO: 692 - RNA, 27 nt, Artificial Sequence
  Synthetic oligonucleotide
uuuguaaaauuuugauucucuuuuuuu

SEQ ID NO: 693 - RNA, 27 nt, Artificial Sequence
  Synthetic oligonucleotide
cuuuguaaaauuuugauucucuuuuuu

SEQ ID NO: 694 - RNA, 27 nt, Artificial Sequence
  Synthetic oligonucleotide
ucuuuguaaaauuuugauucucuuuuu

SEQ ID NO: 695 - RNA, 27 nt, Artificial Sequence
  Synthetic oligonucleotide
uucuuuguaaaauuuugauucucuuuu

SEQ ID NO: 696 - RNA, 27 nt, Artificial Sequence
  Synthetic oligonucleotide
auucuuuguaaaauuuugauucucuuu

SEQ ID NO: 697 - RNA, 27 nt, Artificial Sequence
  Synthetic oligonucleotide
gauucuuuguaaaauuuugauucucuu

SEQ ID NO: 698 - RNA, 27 nt, Artificial Sequence
  Synthetic oligonucleotide
ugauucuuuguaaaauuuugauucucu

SEQ ID NO: 699 - RNA, 27 nt, Artificial Sequence
  Synthetic oligonucleotide
uugauucuuuguaaaauuuugauucuc

SEQ ID NO: 700 - RNA, 27 nt, Artificial Sequence
  Synthetic oligonucleotide
uuugauucuuuguaaaauuuugauucu

SEQ ID NO: 701 - RNA, 27 nt, Artificial Sequence
  Synthetic oligonucleotide
cuuugauucuuuguaaaauuuugauuc

SEQ ID NO: 702 - RNA, 27 nt, Artificial Sequence
  Synthetic oligonucleotide
ccuuugauucuuuguaaaauuuugauu

SEQ ID NO: 703 - RNA, 27 nt, Artificial Sequence
  Synthetic oligonucleotide
uccuuugauucuuuguaaaauuuugau

SEQ ID NO: 704 - RNA, 27 nt, Artificial Sequence
  Synthetic oligonucleotide
uuccuuugauucuuuguaaaauuuuga

SEQ ID NO: 705 - RNA, 27 nt, Artificial Sequence
  Synthetic oligonucleotide
auuccuuugauucuuuguaaaauuuug

SEQ ID NO: 706 - RNA, 27 nt, Artificial Sequence
  Synthetic oligonucleotide
aauuccuuugauucuuuguaaaauuuu

SEQ ID NO: 707 - RNA, 27 nt, Artificial Sequence
  Synthetic oligonucleotide
agaauuccuuugauucuuuguaaaauu

SEQ ID NO: 708 - RNA, 27 nt, Artificial Sequence
  Synthetic oligonucleotide
uagaauuccuuugauucuuuguaaaau

SEQ ID NO: 709 - RNA, 27 nt, Artificial Sequence
  Synthetic oligonucleotide
cuagaauuccuuugauucuuuguaaaa

SEQ ID NO: 710 - RNA, 27 nt, Artificial Sequence
  Synthetic oligonucleotide
ucuagaauuccuuugauucuuuguaaa

SEQ ID NO: 711 - RNA, 27 nt, Artificial Sequence
  Synthetic oligonucleotide
uucuagaauuccuuugauucuuuguaa

SEQ ID NO: 712 - RNA, 27 nt, Artificial Sequence
  Synthetic oligonucleotide
uuucuagaauuccuuugauucuuugua

SEQ ID NO: 713 - RNA, 27 nt, Artificial Sequence
  Synthetic oligonucleotide
cuuucuagaauuccuuugauucuuugu

SEQ ID NO: 714 - RNA, 27 nt, Artificial Sequence
  Synthetic oligonucleotide
acuuucuagaauuccuuugauucuuug

SEQ ID NO: 715 - RNA, 27 nt, Artificial Sequence
  Synthetic oligonucleotide
uacuuucuagaauuccuuugauucuuu

SEQ ID NO: 716 - RNA, 27 nt, Artificial Sequence
  Synthetic oligonucleotide
auacuuucuagaauuccuuugauucuu

SEQ ID NO: 717 - RNA, 27 nt, Artificial Sequence
  Synthetic oligonucleotide
gauacuuucuagaauuccuuugauucu

SEQ ID NO: 718 - RNA, 27 nt, Artificial Sequence
  Synthetic oligonucleotide
agauacuuucuagaauuccuuugauuc

SEQ ID NO: 719 - RNA, 27 nt, Artificial Sequence
  Synthetic oligonucleotide
cagauacuuucuagaauuccuuugauu

SEQ ID NO: 720 - RNA, 27 nt, Artificial Sequence
  Synthetic oligonucleotide
ccagauacuuucuagaauuccuuugau

SEQ ID NO: 721 - RNA, 27 nt, Artificial Sequence
  Synthetic oligonucleotide
cccagauacuuucuagaauuccuuuga

SEQ ID NO: 722 - RNA, 27 nt, Artificial Sequence
  Synthetic oligonucleotide
gacaauggaaauuuggaucucuccuag

SEQ ID NO: 723 - RNA, 27 nt, Artificial Sequence
  Synthetic oligonucleotide
agacaauggaaauuuggaucucuccua

SEQ ID NO: 724 - RNA, 27 nt, Artificial Sequence
  Synthetic oligonucleotide
gcaagacaauggaaauuuggaucucuc

SEQ ID NO: 725 - RNA, 27 nt, Artificial Sequence
  Synthetic oligonucleotide
ugcaagacaauggaaauuuggaucucu

SEQ ID NO: 726 - RNA, 27 nt, Artificial Sequence
  Synthetic oligonucleotide
uugcaagacaauggaaauuuggaucuc

SEQ ID NO: 727 - RNA, 27 nt, Artificial Sequence
  Synthetic oligonucleotide
cuugcaagacaauggaaauuuggaucu

SEQ ID NO: 728 - RNA, 27 nt, Artificial Sequence
  Synthetic oligonucleotide
gcuugcaagacaauggaaauuuggauc

SEQ ID NO: 729 - RNA, 27 nt, Artificial Sequence
  Synthetic oligonucleotide
ugcuugcaagacaauggaaauuuggau

SEQ ID NO: 730 - RNA, 27 nt, Artificial Sequence
  Synthetic oligonucleotide
uugcuugcaagacaauggaaauuugga

SEQ ID NO: 731 - RNA, 27 nt, Artificial Sequence
  Synthetic oligonucleotide
uuugcuugcaagacaauggaaauuugg

SEQ ID NO: 732 - RNA, 27 nt, Artificial Sequence
  Synthetic oligonucleotide
cuuugcuugcaagacaauggaaauuug

SEQ ID NO: 733 - RNA, 27 nt, Artificial Sequence
  Synthetic oligonucleotide
gcuuugcuugcaagacaauggaaauuu

SEQ ID NO: 734 - RNA, 27 nt, Artificial Sequence
  Synthetic oligonucleotide
ugcuuugcuugcaagacaauggaaauu

SEQ ID NO: 735 - RNA, 27 nt, Artificial Sequence
  Synthetic oligonucleotide
gugcuuugcuugcaagacaauggaaau

SEQ ID NO: 736 - RNA, 27 nt, Artificial Sequence
  Synthetic oligonucleotide
cgugcuuugcuugcaagacaauggaaa

SEQ ID NO: 737 - RNA, 27 nt, Artificial Sequence
  Synthetic oligonucleotide
acgugcuuugcuugcaagacaauggaa

SEQ ID NO: 738 - RNA, 27 nt, Artificial Sequence
  Synthetic oligonucleotide
uacgugcuuugcuugcaagacaaugga

SEQ ID NO: 739 - RNA, 27 nt, Artificial Sequence
  Synthetic oligonucleotide
auacgugcuuugcuugcaagacaaugg

SEQ ID NO: 740 - RNA, 27 nt, Artificial Sequence
  Synthetic oligonucleotide
aauacgugcuuugcuugcaagacaaug

SEQ ID NO: 741 - RNA, 27 nt, Artificial Sequence
  Synthetic oligonucleotide
uaauacgugcuuugcuugcaagacaau

SEQ ID NO: 742 - RNA, 27 nt, Artificial Sequence
  Synthetic oligonucleotide
uuaauacgugcuuugcuugcaagacaa

SEQ ID NO: 743 - RNA, 27 nt, Artificial Sequence
  Synthetic oligonucleotide
uuuaauacgugcuuugcuugcaagaca

SEQ ID NO: 744 - RNA, 27 nt, Artificial Sequence
  Synthetic oligonucleotide
auuuaauacgugcuuugcuugcaagac

SEQ ID NO: 745 - RNA, 27 nt, Artificial Sequence
  Synthetic oligonucleotide
uauuuaauacgugcuuugcuugcaaga

SEQ ID NO: 746 - RNA, 27 nt, Artificial Sequence
  Synthetic oligonucleotide
auauuuaauacgugcuuugcuugcaag

SEQ ID NO: 747 - RNA, 27 nt, Artificial Sequence
  Synthetic oligonucleotide
cauauuuaauacgugcuuugcuugcaa

SEQ ID NO: 748 - RNA, 27 nt, Artificial Sequence
  Synthetic oligonucleotide
ucauauuuaauacgugcuuugcuugca

SEQ ID NO: 749 - RNA, 27 nt, Artificial Sequence
  Synthetic oligonucleotide
aucauauuuaauacgugcuuugcuugc

SEQ ID NO: 750 - RNA, 27 nt, Artificial Sequence
  Synthetic oligonucleotide
gaucauauuuaauacgugcuuugcuug

SEQ ID NO: 751 - RNA, 27 nt, Artificial Sequence
  Synthetic oligonucleotide
agaucauauuuaauacgugcuuugcuu

SEQ ID NO: 752 - RNA, 27 nt, Artificial Sequence
  Synthetic oligonucleotide
cagaucauauuuaauacgugcuuugcu

SEQ ID NO: 753 - RNA, 27 nt, Artificial Sequence
  Synthetic oligonucleotide
gcagaucauauuuaauacgugcuuugc

SEQ ID NO: 754 - RNA, 27 nt, Artificial Sequence
  Synthetic oligonucleotide
ugcagaucauauuuaauacgugcuuug

SEQ ID NO: 755 - RNA, 27 nt, Artificial Sequence
  Synthetic oligonucleotide
cugcagaucauauuuaauacgugcuuu

SEQ ID NO: 756 - RNA, 27 nt, Artificial Sequence
  Synthetic oligonucleotide
gcugcagaucauauuuaauacgugcuu

SEQ ID NO: 757 - RNA, 27 nt, Artificial Sequence
  Synthetic oligonucleotide
ggcugcagaucauauuuaauacgugcu

SEQ ID NO: 758 - RNA, 27 nt, Artificial Sequence
  Synthetic oligonucleotide
auggcugcagaucauauuuaauacgug

SEQ ID NO: 759 - RNA, 27 nt, Artificial Sequence
  Synthetic oligonucleotide
aauggcugcagaucauauuuaauacgu

SEQ ID NO: 760 - RNA, 27 nt, Artificial Sequence
  Synthetic oligonucleotide
uuaauggcugcagaucauauuuaauac

SEQ ID NO: 761 - RNA, 27 nt, Artificial Sequence
  Synthetic oligonucleotide
uuuaauggcugcagaucauauuuaaua

SEQ ID NO: 762 - RNA, 27 nt, Artificial Sequence
  Synthetic oligonucleotide
uuuuaauggcugcagaucauauuuaau

SEQ ID NO: 763 - RNA, 27 nt, Artificial Sequence
  Synthetic oligonucleotide
uuuuuaauggcugcagaucauauuuaa

SEQ ID NO: 764 - RNA, 27 nt, Artificial Sequence
  Synthetic oligonucleotide
cuuuuuaauggcugcagaucauauuua

SEQ ID NO: 765 - RNA, 27 nt, Artificial Sequence
  Synthetic oligonucleotide
ucuuuuuaauggcugcagaucauauuu

SEQ ID NO: 766 - RNA, 27 nt, Artificial Sequence
  Synthetic oligonucleotide
gucuuuuuaauggcugcagaucauauu

SEQ ID NO: 767 - RNA, 27 nt, Artificial Sequence
  Synthetic oligonucleotide
ugucuuuuuaauggcugcagaucauau

SEQ ID NO: 768 - RNA, 27 nt, Artificial Sequence
  Synthetic oligonucleotide
gugucuuuuuaauggcugcagaucaua

SEQ ID NO: 769 - DNA, 27 bp, Artificial Sequence
  Synthetic oligonucleotide
gttgactaagtcaataatcagaatcag

SEQ ID NO: 770 - DNA, 27 bp, Artificial Sequence
  Synthetic oligonucleotide
ttgactaagtcaataatcagaatcagc

SEQ ID NO: 771 - DNA, 27 bp, Artificial Sequence
  Synthetic oligonucleotide
tgactaagtcaataatcagaatcagca

SEQ ID NO: 772 - DNA, 27 bp, Artificial Sequence
  Synthetic oligonucleotide
gactaagtcaataatcagaatcagcag

SEQ ID NO: 773 - DNA, 27 bp, Artificial Sequence
  Synthetic oligonucleotide
actaagtcaataatcagaatcagcagg

SEQ ID NO: 774 - DNA, 27 bp, Artificial Sequence
  Synthetic oligonucleotide
ctaagtcaataatcagaatcagcaggt

SEQ ID NO: 775 - DNA, 27 bp, Artificial Sequence
  Synthetic oligonucleotide
taagtcaataatcagaatcagcaggtt

SEQ ID NO: 776 - DNA, 27 bp, Artificial Sequence
  Synthetic oligonucleotide
aagtcaataatcagaatcagcaggttt

SEQ ID NO: 777 - DNA, 27 bp, Artificial Sequence
  Synthetic oligonucleotide
agtcaataatcagaatcagcaggtttg

SEQ ID NO: 778 - DNA, 27 bp, Artificial Sequence
  Synthetic oligonucleotide
gtcaataatcagaatcagcaggtttgc

SEQ ID NO: 779 - DNA, 27 bp, Artificial Sequence
  Synthetic oligonucleotide
tcaataatcagaatcagcaggtttgca

SEQ ID NO: 780 - DNA, 27 bp, Artificial Sequence
  Synthetic oligonucleotide
caataatcagaatcagcaggtttgcag

SEQ ID NO: 781 - DNA, 27 bp, Artificial Sequence
  Synthetic oligonucleotide
aataatcagaatcagcaggtttgcagt

SEQ ID NO: 782 - DNA, 27 bp, Artificial Sequence
  Synthetic oligonucleotide
ataatcagaatcagcaggtttgcagtc

SEQ ID NO: 783 - DNA, 27 bp, Artificial Sequence
  Synthetic oligonucleotide
taatcagaatcagcaggtttgcagtca

SEQ ID NO: 784 - DNA, 27 bp, Artificial Sequence
  Synthetic oligonucleotide
atcagaatcagcaggtttgcagtcaga

SEQ ID NO: 785 - DNA, 27 bp, Artificial Sequence
  Synthetic oligonucleotide
tcagaatcagcaggtttgcagtcagat

SEQ ID NO: 786 - DNA, 27 bp, Artificial Sequence
  Synthetic oligonucleotide
agaatcagcaggtttgcagtcagattg

SEQ ID NO: 787 - DNA, 27 bp, Artificial Sequence
  Synthetic oligonucleotide
gaatcagcaggtttgcagtcagattgg

SEQ ID NO: 788 - DNA, 27 bp, Artificial Sequence
  Synthetic oligonucleotide
ttgcagtcagattggcagggataagca

SEQ ID NO: 789 - DNA, 27 bp, Artificial Sequence
  Synthetic oligonucleotide
cagcctagctcaggagaagtgagtata

SEQ ID NO: 790 - DNA, 27 bp, Artificial Sequence
  Synthetic oligonucleotide
cctagctcaggagaagtgagtataaaa

SEQ ID NO: 791 - DNA, 27 bp, Artificial Sequence
  Synthetic oligonucleotide
ctagctcaggagaagtgagtataaaag

SEQ ID NO: 792 - DNA, 27 bp, Artificial Sequence
  Synthetic oligonucleotide
tagctcaggagaagtgagtataaaagc

SEQ ID NO: 793 - DNA, 27 bp, Artificial Sequence
  Synthetic oligonucleotide
agctcaggagaagtgagtataaaagcc

SEQ ID NO: 794 - DNA, 27 bp, Artificial Sequence
  Synthetic oligonucleotide
ctcaggagaagtgagtataaaagcccc

SEQ ID NO: 795 - DNA, 27 bp, Artificial Sequence
  Synthetic oligonucleotide
gagcagccatcacagaagtccactcat

SEQ ID NO: 796 - DNA, 27 bp, Artificial Sequence
  Synthetic oligonucleotide
agcagccatcacagaagtccactcatt

SEQ ID NO: 797 - DNA, 27 bp, Artificial Sequence
  Synthetic oligonucleotide
gcagccatcacagaagtccactcattc

SEQ ID NO: 798 - DNA, 27 bp, Artificial Sequence
  Synthetic oligonucleotide
cagccatcacagaagtccactcattct

SEQ ID NO: 799 - DNA, 27 bp, Artificial Sequence
  Synthetic oligonucleotide
agccatcacagaagtccactcattctt

SEQ ID NO: 800 - DNA, 27 bp, Artificial Sequence
  Synthetic oligonucleotide
gccatcacagaagtccactcattcttg

SEQ ID NO: 801 - DNA, 27 bp, Artificial Sequence
  Synthetic oligonucleotide
ccatcacagaagtccactcattcttgg

SEQ ID NO: 802 - DNA, 27 bp, Artificial Sequence
  Synthetic oligonucleotide
atcacagaagtccactcattcttggca

SEQ ID NO: 803 - DNA, 27 bp, Artificial Sequence
  Synthetic oligonucleotide
tcacagaagtccactcattcttggcag

SEQ ID NO: 804 - DNA, 27 bp, Artificial Sequence
  Synthetic oligonucleotide
cattcttggcaggatggcttctcatcg

SEQ ID NO: 805 - DNA, 27 bp, Artificial Sequence
  Synthetic oligonucleotide
attcttggcaggatggcttctcatcgt

SEQ ID NO: 806 - DNA, 27 bp, Artificial Sequence
  Synthetic oligonucleotide
ttcttggcaggatggcttctcatcgtc

SEQ ID NO: 807 - DNA, 27 bp, Artificial Sequence
  Synthetic oligonucleotide
tcttggcaggatggcttctcatcgtct

SEQ ID NO: 808 - DNA, 27 bp, Artificial Sequence
  Synthetic oligonucleotide
cttggcaggatggcttctcatcgtctg

SEQ ID NO: 809 - DNA, 27 bp, Artificial Sequence
  Synthetic oligonucleotide
ttggcaggatggcttctcatcgtctgc

SEQ ID NO: 810 - DNA, 27 bp, Artificial Sequence
  Synthetic oligonucleotide
tggcaggatggcttctcatcgtctgct

SEQ ID NO: 811 - DNA, 27 bp, Artificial Sequence
  Synthetic oligonucleotide
ggcaggatggcttctcatcgtctgctc

SEQ ID NO: 812 - DNA, 27 bp, Artificial Sequence
  Synthetic oligonucleotide
gcaggatggcttctcatcgtctgctcc

SEQ ID NO: 813 - DNA, 27 bp, Artificial Sequence
  Synthetic oligonucleotide
caggatggcttctcatcgtctgctcct

SEQ ID NO: 814 - DNA, 27 bp, Artificial Sequence
  Synthetic oligonucleotide
aggatggcttctcatcgtctgctcctc

SEQ ID NO: 815 - DNA, 27 bp, Artificial Sequence
  Synthetic oligonucleotide
ggatggcttctcatcgtctgctcctcc

SEQ ID NO: 816 - DNA, 27 bp, Artificial Sequence
  Synthetic oligonucleotide
gatggcttctcatcgtctgctcctcct

SEQ ID NO: 817 - DNA, 27 bp, Artificial Sequence
  Synthetic oligonucleotide
atggcttctcatcgtctgctcctcctc

SEQ ID NO: 818 - DNA, 27 bp, Artificial Sequence
  Synthetic oligonucleotide
tggcttctcatcgtctgctcctcctct

SEQ ID NO: 819 - DNA, 27 bp, Artificial Sequence
  Synthetic oligonucleotide
ggcttctcatcgtctgctcctcctctg

SEQ ID NO: 820 - DNA, 27 bp, Artificial Sequence
  Synthetic oligonucleotide
cctctgccttgctggactggtatttgt

SEQ ID NO: 821 - DNA, 27 bp, Artificial Sequence
  Synthetic oligonucleotide
ctctgccttgctggactggtatttgtg

SEQ ID NO: 822 - DNA, 27 bp, Artificial Sequence
  Synthetic oligonucleotide
caccggtgaatccaagtgtcctctgat

SEQ ID NO: 823 - DNA, 27 bp, Artificial Sequence
  Synthetic oligonucleotide
ggtgaatccaagtgtcctctgatggtc

SEQ ID NO: 824 - DNA, 27 bp, Artificial Sequence
  Synthetic oligonucleotide
gtgaatccaagtgtcctctgatggtca

SEQ ID NO: 825 - DNA, 27 bp, Artificial Sequence
  Synthetic oligonucleotide
tgaatccaagtgtcctctgatggtcaa

SEQ ID NO: 826 - DNA, 27 bp, Artificial Sequence
  Synthetic oligonucleotide
gaatccaagtgtcctctgatggtcaaa

SEQ ID NO: 827 - DNA, 27 bp, Artificial Sequence
  Synthetic oligonucleotide
aatccaagtgtcctctgatggtcaaag

SEQ ID NO: 828 - DNA, 27 bp, Artificial Sequence
  Synthetic oligonucleotide
atccaagtgtcctctgatggtcaaagt

SEQ ID NO: 829 - DNA, 27 bp, Artificial Sequence
  Synthetic oligonucleotide
tccaagtgtcctctgatggtcaaagtt

SEQ ID NO: 830 - DNA, 27 bp, Artificial Sequence
  Synthetic oligonucleotide
ccaagtgtcctctgatggtcaaagttc

SEQ ID NO: 831 - DNA, 27 bp, Artificial Sequence
  Synthetic oligonucleotide
caagtgtcctctgatggtcaaagttct

SEQ ID NO: 832 - DNA, 27 bp, Artificial Sequence
  Synthetic oligonucleotide
aagtgtcctctgatggtcaaagttcta

SEQ ID NO: 833 - DNA, 27 bp, Artificial Sequence
  Synthetic oligonucleotide
agtgtcctctgatggtcaaagttctag

SEQ ID NO: 834 - DNA, 27 bp, Artificial Sequence
  Synthetic oligonucleotide
gtgtcctctgatggtcaaagttctaga

SEQ ID NO: 835 - DNA, 27 bp, Artificial Sequence
  Synthetic oligonucleotide
tgtcctctgatggtcaaagttctagat

SEQ ID NO: 836 - DNA, 27 bp, Artificial Sequence
  Synthetic oligonucleotide
gtcctctgatggtcaaagttctagatg

SEQ ID NO: 837 - DNA, 27 bp, Artificial Sequence
  Synthetic oligonucleotide
tcctctgatggtcaaagttctagatgc

SEQ ID NO: 838 - DNA, 27 bp, Artificial Sequence
  Synthetic oligonucleotide
cctctgatggtcaaagttctagatgct

SEQ ID NO: 839 - DNA, 27 bp, Artificial Sequence
  Synthetic oligonucleotide
ctctgatggtcaaagttctagatgctg

SEQ ID NO: 840 - DNA, 27 bp, Artificial Sequence
  Synthetic oligonucleotide
tctgatggtcaaagttctagatgctgt

SEQ ID NO: 841 - DNA, 27 bp, Artificial Sequence
  Synthetic oligonucleotide
ctgatggtcaaagttctagatgctgtc

SEQ ID NO: 842 - DNA, 27 bp, Artificial Sequence
  Synthetic oligonucleotide
tgatggtcaaagttctagatgctgtcc

SEQ ID NO: 843 - DNA, 27 bp, Artificial Sequence
  Synthetic oligonucleotide
gatggtcaaagttctagatgctgtccg

SEQ ID NO: 844 - DNA, 27 bp, Artificial Sequence
  Synthetic oligonucleotide
gagccatttgcctctgggaaaaccagt

SEQ ID NO: 845 - DNA, 27 bp, Artificial Sequence
  Synthetic oligonucleotide
agccatttgcctctgggaaaaccagtg

SEQ ID NO: 846 - DNA, 27 bp, Artificial Sequence
  Synthetic oligonucleotide
gccatttgcctctgggaaaaccagtga

SEQ ID NO: 847 - DNA, 27 bp, Artificial Sequence
  Synthetic oligonucleotide
ccatttgcctctgggaaaaccagtgag

SEQ ID NO: 848 - DNA, 27 bp, Artificial Sequence
  Synthetic oligonucleotide
catttgcctctgggaaaaccagtgagt

SEQ ID NO: 849 - DNA, 27 bp, Artificial Sequence
  Synthetic oligonucleotide
atttgcctctgggaaaaccagtgagtc

SEQ ID NO: 850 - DNA, 27 bp, Artificial Sequence
  Synthetic oligonucleotide
tttgcctctgggaaaaccagtgagtct

SEQ ID NO: 851 - DNA, 27 bp, Artificial Sequence
  Synthetic oligonucleotide
ttgcctctgggaaaaccagtgagtctg

SEQ ID NO: 852 - DNA, 27 bp, Artificial Sequence
  Synthetic oligonucleotide
tgcctctgggaaaaccagtgagtctgg

SEQ ID NO: 853 - DNA, 27 bp, Artificial Sequence
  Synthetic oligonucleotide
gcctctgggaaaaccagtgagtctgga

SEQ ID NO: 854 - DNA, 27 bp, Artificial Sequence
  Synthetic oligonucleotide
cctctgggaaaaccagtgagtctggag

SEQ ID NO: 855 - DNA, 27 bp, Artificial Sequence
  Synthetic oligonucleotide
ctctgggaaaaccagtgagtctggaga

SEQ ID NO: 856 - DNA, 27 bp, Artificial Sequence
  Synthetic oligonucleotide
tctgggaaaaccagtgagtctggagag

SEQ ID NO: 857 - DNA, 27 bp, Artificial Sequence
  Synthetic oligonucleotide
ctgggaaaaccagtgagtctggagagc

SEQ ID NO: 858 - DNA, 27 bp, Artificial Sequence
  Synthetic oligonucleotide
tgggaaaaccagtgagtctggagagct

SEQ ID NO: 859 - DNA, 27 bp, Artificial Sequence
  Synthetic oligonucleotide
gggaaaaccagtgagtctggagagctg

SEQ ID NO: 860 - DNA, 27 bp, Artificial Sequence
  Synthetic oligonucleotide
agagctgcatgggctcacaactgagga

SEQ ID NO: 861 - DNA, 27 bp, Artificial Sequence
  Synthetic oligonucleotide
gagctgcatgggctcacaactgaggag

SEQ ID NO: 862 - DNA, 27 bp, Artificial Sequence
  Synthetic oligonucleotide
agctgcatgggctcacaactgaggagg

SEQ ID NO: 863 - DNA, 27 bp, Artificial Sequence
  Synthetic oligonucleotide
gctgcatgggctcacaactgaggagga

SEQ ID NO: 864 - DNA, 27 bp, Artificial Sequence
  Synthetic oligonucleotide
ctgcatgggctcacaactgaggaggaa

SEQ ID NO: 865 - DNA, 27 bp, Artificial Sequence
  Synthetic oligonucleotide
tgcatgggctcacaactgaggaggaat

SEQ ID NO: 866 - DNA, 27 bp, Artificial Sequence
  Synthetic oligonucleotide
gcatgggctcacaactgaggaggaatt

SEQ ID NO: 867 - DNA, 27 bp, Artificial Sequence
  Synthetic oligonucleotide
catgggctcacaactgaggaggaattt

SEQ ID NO: 868 - DNA, 27 bp, Artificial Sequence
  Synthetic oligonucleotide
atgggctcacaactgaggaggaatttg

SEQ ID NO: 869 - DNA, 27 bp, Artificial Sequence
  Synthetic oligonucleotide
tgggctcacaactgaggaggaatttgt

SEQ ID NO: 870 - DNA, 27 bp, Artificial Sequence
  Synthetic oligonucleotide
gggctcacaactgaggaggaatttgta

SEQ ID NO: 871 - DNA, 27 bp, Artificial Sequence
  Synthetic oligonucleotide
ggctcacaactgaggaggaatttgtag

SEQ ID NO: 872 - DNA, 27 bp, Artificial Sequence
  Synthetic oligonucleotide
gctcacaactgaggaggaatttgtaga

SEQ ID NO: 873 - DNA, 27 bp, Artificial Sequence
  Synthetic oligonucleotide
ctcacaactgaggaggaatttgtagaa

SEQ ID NO: 874 - DNA, 27 bp, Artificial Sequence
  Synthetic oligonucleotide
tcacaactgaggaggaatttgtagaag

SEQ ID NO: 875 - DNA, 27 bp, Artificial Sequence
  Synthetic oligonucleotide
cacaactgaggaggaatttgtagaagg

SEQ ID NO: 876 - DNA, 27 bp, Artificial Sequence
  Synthetic oligonucleotide
caactgaggaggaatttgtagaaggga

SEQ ID NO: 877 - DNA, 27 bp, Artificial Sequence
  Synthetic oligonucleotide
aactgaggaggaatttgtagaagggat

SEQ ID NO: 878 - DNA, 27 bp, Artificial Sequence
  Synthetic oligonucleotide
actgaggaggaatttgtagaagggata

SEQ ID NO: 879 - DNA, 27 bp, Artificial Sequence
  Synthetic oligonucleotide
ctgaggaggaatttgtagaagggatat

SEQ ID NO: 880 - DNA, 27 bp, Artificial Sequence
  Synthetic oligonucleotide
tgaggaggaatttgtagaagggatata

SEQ ID NO: 881 - DNA, 27 bp, Artificial Sequence
  Synthetic oligonucleotide
gaggaggaatttgtagaagggatatac

SEQ ID NO: 882 - DNA, 27 bp, Artificial Sequence
  Synthetic oligonucleotide
aggaggaatttgtagaagggatataca

SEQ ID NO: 883 - DNA, 27 bp, Artificial Sequence
  Synthetic oligonucleotide
ggaggaatttgtagaagggatatacaa

SEQ ID NO: 884 - DNA, 27 bp, Artificial Sequence
  Synthetic oligonucleotide
gaggaatttgtagaagggatatacaaa

SEQ ID NO: 885 - DNA, 27 bp, Artificial Sequence
  Synthetic oligonucleotide
aggaatttgtagaagggatatacaaag

SEQ ID NO: 886 - DNA, 27 bp, Artificial Sequence
  Synthetic oligonucleotide
ggaatttgtagaagggatatacaaagt

SEQ ID NO: 887 - DNA, 27 bp, Artificial Sequence
  Synthetic oligonucleotide
gaatttgtagaagggatatacaaagtg

SEQ ID NO: 888 - DNA, 27 bp, Artificial Sequence
  Synthetic oligonucleotide
aatttgtagaagggatatacaaagtgg

SEQ ID NO: 889 - DNA, 27 bp, Artificial Sequence
  Synthetic oligonucleotide
atttgtagaagggatatacaaagtgga

SEQ ID NO: 890 - DNA, 27 bp, Artificial Sequence
  Synthetic oligonucleotide
tttgtagaagggatatacaaagtggaa

SEQ ID NO: 891 - DNA, 27 bp, Artificial Sequence
  Synthetic oligonucleotide
ttgtagaagggatatacaaagtggaaa

SEQ ID NO: 892 - DNA, 27 bp, Artificial Sequence
  Synthetic oligonucleotide
tgtagaagggatatacaaagtggaaat

SEQ ID NO: 893 - DNA, 27 bp, Artificial Sequence
  Synthetic oligonucleotide
gtagaagggatatacaaagtggaaata

SEQ ID NO: 894 - DNA, 27 bp, Artificial Sequence
  Synthetic oligonucleotide
tagaagggatatacaaagtggaaatag

SEQ ID NO: 895 - DNA, 27 bp, Artificial Sequence
  Synthetic oligonucleotide
agaagggatatacaaagtggaaataga

SEQ ID NO: 896 - DNA, 27 bp, Artificial Sequence
  Synthetic oligonucleotide
gaagggatatacaaagtggaaatagac

SEQ ID NO: 897 - DNA, 27 bp, Artificial Sequence
  Synthetic oligonucleotide
aagggatatacaaagtggaaatagaca

SEQ ID NO: 898 - DNA, 27 bp, Artificial Sequence
  Synthetic oligonucleotide
agggatatacaaagtggaaatagacac

SEQ ID NO: 899 - DNA, 27 bp, Artificial Sequence
  Synthetic oligonucleotide
gggatatacaaagtggaaatagacacc

SEQ ID NO: 900 - DNA, 27 bp, Artificial Sequence
  Synthetic oligonucleotide
ggatatacaaagtggaaatagacacca

SEQ ID NO: 901 - DNA, 27 bp, Artificial Sequence
  Synthetic oligonucleotide
gatatacaaagtggaaatagacaccaa

SEQ ID NO: 902 - DNA, 27 bp, Artificial Sequence
  Synthetic oligonucleotide
atatacaaagtggaaatagacaccaaa

SEQ ID NO: 903 - DNA, 27 bp, Artificial Sequence
  Synthetic oligonucleotide
tatacaaagtggaaatagacaccaaat

SEQ ID NO: 904 - DNA, 27 bp, Artificial Sequence
  Synthetic oligonucleotide
atacaaagtggaaatagacaccaaatc

SEQ ID NO: 905 - DNA, 27 bp, Artificial Sequence
  Synthetic oligonucleotide
tacaaagtggaaatagacaccaaatct

SEQ ID NO: 906 - DNA, 27 bp, Artificial Sequence
  Synthetic oligonucleotide
acaaagtggaaatagacaccaaatctt

SEQ ID NO: 907 - DNA, 27 bp, Artificial Sequence
  Synthetic oligonucleotide
caaagtggaaatagacaccaaatctta

SEQ ID NO: 908 - DNA, 27 bp, Artificial Sequence
  Synthetic oligonucleotide
aaagtggaaatagacaccaaatcttac

SEQ ID NO: 909 - DNA, 27 bp, Artificial Sequence
  Synthetic oligonucleotide
aagtggaaatagacaccaaatcttact

SEQ ID NO: 910 - DNA, 27 bp, Artificial Sequence
  Synthetic oligonucleotide
agtggaaatagacaccaaatcttactg

SEQ ID NO: 911 - DNA, 27 bp, Artificial Sequence
  Synthetic oligonucleotide
gtggaaatagacaccaaatcttactgg

SEQ ID NO: 912 - DNA, 27 bp, Artificial Sequence
  Synthetic oligonucleotide
tggaaatagacaccaaatcttactgga

SEQ ID NO: 913 - DNA, 27 bp, Artificial Sequence
  Synthetic oligonucleotide
ggaaatagacaccaaatcttactggaa

SEQ ID NO: 914 - DNA, 27 bp, Artificial Sequence
  Synthetic oligonucleotide
gaaatagacaccaaatcttactggaag

SEQ ID NO: 915 - DNA, 27 bp, Artificial Sequence
  Synthetic oligonucleotide
aaatagacaccaaatcttactggaagg

SEQ ID NO: 916 - DNA, 27 bp, Artificial Sequence
  Synthetic oligonucleotide
atagacaccaaatcttactggaaggca

SEQ ID NO: 917 - DNA, 27 bp, Artificial Sequence
  Synthetic oligonucleotide
tagacaccaaatcttactggaaggcac

SEQ ID NO: 918 - DNA, 27 bp, Artificial Sequence
  Synthetic oligonucleotide
ggcacttggcatctccccattccatga

SEQ ID NO: 919 - DNA, 27 bp, Artificial Sequence
  Synthetic oligonucleotide
gcacttggcatctccccattccatgag

SEQ ID NO: 920 - DNA, 27 bp, Artificial Sequence
  Synthetic oligonucleotide
cacttggcatctccccattccatgagc

SEQ ID NO: 921 - DNA, 27 bp, Artificial Sequence
  Synthetic oligonucleotide
acttggcatctccccattccatgagca

SEQ ID NO: 922 - DNA, 27 bp, Artificial Sequence
  Synthetic oligonucleotide
cttggcatctccccattccatgagcat

SEQ ID NO: 923 - DNA, 27 bp, Artificial Sequence
  Synthetic oligonucleotide
ttggcatctccccattccatgagcatg

SEQ ID NO: 924 - DNA, 27 bp, Artificial Sequence
  Synthetic oligonucleotide
tggcatctccccattccatgagcatgc

SEQ ID NO: 925 - DNA, 27 bp, Artificial Sequence
  Synthetic oligonucleotide
ggcatctccccattccatgagcatgca

SEQ ID NO: 926 - DNA, 27 bp, Artificial Sequence
  Synthetic oligonucleotide
gcatctccccattccatgagcatgcag

SEQ ID NO: 927 - DNA, 27 bp, Artificial Sequence
  Synthetic oligonucleotide
catctccccattccatgagcatgcaga

SEQ ID NO: 928 - DNA, 27 bp, Artificial Sequence
  Synthetic oligonucleotide
atctccccattccatgagcatgcagag

SEQ ID NO: 929 - DNA, 27 bp, Artificial Sequence
  Synthetic oligonucleotide
tctccccattccatgagcatgcagagg

SEQ ID NO: 930 - DNA, 27 bp, Artificial Sequence
  Synthetic oligonucleotide
ctccccattccatgagcatgcagaggt

SEQ ID NO: 931 - DNA, 27 bp, Artificial Sequence
  Synthetic oligonucleotide
tccatgagcatgcagaggtggtattca

SEQ ID NO: 932 - DNA, 27 bp, Artificial Sequence
  Synthetic oligonucleotide
ccatgagcatgcagaggtggtattcac

SEQ ID NO: 933 - DNA, 27 bp, Artificial Sequence
  Synthetic oligonucleotide
catgagcatgcagaggtggtattcaca

SEQ ID NO: 934 - DNA, 27 bp, Artificial Sequence
  Synthetic oligonucleotide
atgagcatgcagaggtggtattcacag

SEQ ID NO: 935 - DNA, 27 bp, Artificial Sequence
  Synthetic oligonucleotide
gcatgcagaggtggtattcacagccaa

SEQ ID NO: 936 - DNA, 27 bp, Artificial Sequence
  Synthetic oligonucleotide
gcagaggtggtattcacagccaacgac

SEQ ID NO: 937 - DNA, 27 bp, Artificial Sequence
  Synthetic oligonucleotide
cagaggtggtattcacagccaacgact

SEQ ID NO: 938 - DNA, 27 bp, Artificial Sequence
  Synthetic oligonucleotide
ctgtcgtcaccaatcccaaggaatgag

SEQ ID NO: 939 - DNA, 27 bp, Artificial Sequence
  Synthetic oligonucleotide
aaggacgagggatgggatttcatgtaa

SEQ ID NO: 940 - DNA, 27 bp, Artificial Sequence
  Synthetic oligonucleotide
aggacgagggatgggatttcatgtaac

SEQ ID NO: 941 - DNA, 27 bp, Artificial Sequence
  Synthetic oligonucleotide
acgagggatgggatttcatgtaaccaa

SEQ ID NO: 942 - DNA, 27 bp, Artificial Sequence
  Synthetic oligonucleotide
cgagggatgggatttcatgtaaccaag

SEQ ID NO: 943 - DNA, 27 bp, Artificial Sequence
  Synthetic oligonucleotide
gagggatgggatttcatgtaaccaaga

SEQ ID NO: 944 - DNA, 27 bp, Artificial Sequence
  Synthetic oligonucleotide
gggatgggatttcatgtaaccaagagt

SEQ ID NO: 945 - DNA, 27 bp, Artificial Sequence
  Synthetic oligonucleotide
ggatgggatttcatgtaaccaagagta

SEQ ID NO: 946 - DNA, 27 bp, Artificial Sequence
  Synthetic oligonucleotide
gatgggatttcatgtaaccaagagtat

SEQ ID NO: 947 - DNA, 27 bp, Artificial Sequence
  Synthetic oligonucleotide
atgggatttcatgtaaccaagagtatt

SEQ ID NO: 948 - DNA, 27 bp, Artificial Sequence
  Synthetic oligonucleotide
tgggatttcatgtaaccaagagtattc

SEQ ID NO: 949 - DNA, 27 bp, Artificial Sequence
  Synthetic oligonucleotide
gggatttcatgtaaccaagagtattcc

SEQ ID NO: 950 - DNA, 27 bp, Artificial Sequence
  Synthetic oligonucleotide
ggatttcatgtaaccaagagtattcca

SEQ ID NO: 951 - DNA, 27 bp, Artificial Sequence
  Synthetic oligonucleotide
gatttcatgtaaccaagagtattccat

SEQ ID NO: 952 - DNA, 27 bp, Artificial Sequence
  Synthetic oligonucleotide
atttcatgtaaccaagagtattccatt

SEQ ID NO: 953 - DNA, 27 bp, Artificial Sequence
  Synthetic oligonucleotide
tttcatgtaaccaagagtattccattt

SEQ ID NO: 954 - DNA, 27 bp, Artificial Sequence
  Synthetic oligonucleotide
ttcatgtaaccaagagtattccatttt

SEQ ID NO: 955 - DNA, 27 bp, Artificial Sequence
  Synthetic oligonucleotide
tcatgtaaccaagagtattccattttt

SEQ ID NO: 956 - DNA, 27 bp, Artificial Sequence
  Synthetic oligonucleotide
catgtaaccaagagtattccattttta

SEQ ID NO: 957 - DNA, 27 bp, Artificial Sequence
  Synthetic oligonucleotide
atgtaaccaagagtattccatttttac

SEQ ID NO: 958 - DNA, 27 bp, Artificial Sequence
  Synthetic oligonucleotide
tgtaaccaagagtattccatttttact

SEQ ID NO: 959 - DNA, 27 bp, Artificial Sequence
  Synthetic oligonucleotide
gtaaccaagagtattccatttttacta

SEQ ID NO: 960 - DNA, 27 bp, Artificial Sequence
  Synthetic oligonucleotide
taaccaagagtattccatttttactaa

SEQ ID NO: 961 - DNA, 27 bp, Artificial Sequence
  Synthetic oligonucleotide
aaccaagagtattccatttttactaaa

SEQ ID NO: 962 - DNA, 27 bp, Artificial Sequence
  Synthetic oligonucleotide
accaagagtattccatttttactaaag

SEQ ID NO: 963 - DNA, 27 bp, Artificial Sequence
  Synthetic oligonucleotide
ccaagagtattccatttttactaaagc

SEQ ID NO: 964 - DNA, 27 bp, Artificial Sequence
  Synthetic oligonucleotide
caagagtattccatttttactaaagca

SEQ ID NO: 965 - DNA, 27 bp, Artificial Sequence
  Synthetic oligonucleotide
aagagtattccatttttactaaagcag

SEQ ID NO: 966 - DNA, 27 bp, Artificial Sequence
  Synthetic oligonucleotide
agagtattccatttttactaaagcagt

SEQ ID NO: 967 - DNA, 27 bp, Artificial Sequence
  Synthetic oligonucleotide
gagtattccatttttactaaagcagtg

SEQ ID NO: 968 - DNA, 27 bp, Artificial Sequence
  Synthetic oligonucleotide
agtattccatttttactaaagcagtgt

SEQ ID NO: 969 - DNA, 27 bp, Artificial Sequence
  Synthetic oligonucleotide
gtattccatttttactaaagcagtgtt

SEQ ID NO: 970 - DNA, 27 bp, Artificial Sequence
  Synthetic oligonucleotide
tattccatttttactaaagcagtgttt

SEQ ID NO: 971 - DNA, 27 bp, Artificial Sequence
  Synthetic oligonucleotide
attccatttttactaaagcagtgtttt

SEQ ID NO: 972 - DNA, 27 bp, Artificial Sequence
  Synthetic oligonucleotide
ttccatttttactaaagcagtgttttc

SEQ ID NO: 973 - DNA, 27 bp, Artificial Sequence
  Synthetic oligonucleotide
tccatttttactaaagcagtgttttca

SEQ ID NO: 974 - DNA, 27 bp, Artificial Sequence
  Synthetic oligonucleotide
ccatttttactaaagcagtgttttcac

SEQ ID NO: 975 - DNA, 27 bp, Artificial Sequence
  Synthetic oligonucleotide
catttttactaaagcagtgttttcacc

SEQ ID NO: 976 - DNA, 27 bp, Artificial Sequence
  Synthetic oligonucleotide
atttttactaaagcagtgttttcacct

SEQ ID NO: 977 - DNA, 27 bp, Artificial Sequence
  Synthetic oligonucleotide
tttttactaaagcagtgttttcacctc

SEQ ID NO: 978 - DNA, 27 bp, Artificial Sequence
  Synthetic oligonucleotide
ttttactaaagcagtgttttcacctca

SEQ ID NO: 979 - DNA, 27 bp, Artificial Sequence
  Synthetic oligonucleotide
tttactaaagcagtgttttcacctcat

SEQ ID NO: 980 - DNA, 27 bp, Artificial Sequence
  Synthetic oligonucleotide
ttactaaagcagtgttttcacctcata

SEQ ID NO: 981 - DNA, 27 bp, Artificial Sequence
  Synthetic oligonucleotide
tactaaagcagtgttttcacctcatat

SEQ ID NO: 982 - DNA, 27 bp, Artificial Sequence
  Synthetic oligonucleotide
actaaagcagtgttttcacctcatatg

SEQ ID NO: 983 - DNA, 27 bp, Artificial Sequence
  Synthetic oligonucleotide
ctaaagcagtgttttcacctcatatgc

SEQ ID NO: 984 - DNA, 27 bp, Artificial Sequence
  Synthetic oligonucleotide
taaagcagtgttttcacctcatatgct

SEQ ID NO: 985 - DNA, 27 bp, Artificial Sequence
  Synthetic oligonucleotide
aaagcagtgttttcacctcatatgcta

SEQ ID NO: 986 - DNA, 27 bp, Artificial Sequence
  Synthetic oligonucleotide
aagcagtgttttcacctcatatgctat

SEQ ID NO: 987 - DNA, 27 bp, Artificial Sequence
  Synthetic oligonucleotide
agcagtgttttcacctcatatgctatg

SEQ ID NO: 988 - DNA, 27 bp, Artificial Sequence
  Synthetic oligonucleotide
gcagtgttttcacctcatatgctatgt

SEQ ID NO: 989 - DNA, 27 bp, Artificial Sequence
  Synthetic oligonucleotide
cagtgttttcacctcatatgctatgtt

SEQ ID NO: 990 - DNA, 27 bp, Artificial Sequence
  Synthetic oligonucleotide
agtgttttcacctcatatgctatgtta

SEQ ID NO: 991 - DNA, 27 bp, Artificial Sequence
  Synthetic oligonucleotide
gtgttttcacctcatatgctatgttag

SEQ ID NO: 992 - DNA, 27 bp, Artificial Sequence
  Synthetic oligonucleotide
tgttttcacctcatatgctatgttaga

SEQ ID NO: 993 - DNA, 27 bp, Artificial Sequence
  Synthetic oligonucleotide
gttttcacctcatatgctatgttagaa

SEQ ID NO: 994 - DNA, 27 bp, Artificial Sequence
  Synthetic oligonucleotide
ttttcacctcatatgctatgttagaag

SEQ ID NO: 995 - DNA, 27 bp, Artificial Sequence
  Synthetic oligonucleotide
tttcacctcatatgctatgttagaagt

SEQ ID NO: 996 - DNA, 27 bp, Artificial Sequence
  Synthetic oligonucleotide
ttcacctcatatgctatgttagaagtc

SEQ ID NO: 997 - DNA, 27 bp, Artificial Sequence
  Synthetic oligonucleotide
tcacctcatatgctatgttagaagtcc

SEQ ID NO: 998 - DNA, 27 bp, Artificial Sequence
  Synthetic oligonucleotide
cacctcatatgctatgttagaagtcca

SEQ ID NO: 999 - DNA, 27 bp, Artificial Sequence
  Synthetic oligonucleotide
acctcatatgctatgttagaagtccag

SEQ ID NO: 1000 - DNA, 27 bp, Artificial Sequence
  Synthetic oligonucleotide
cctcatatgctatgttagaagtccagg

SEQ ID NO: 1001 - DNA, 27 bp, Artificial Sequence
  Synthetic oligonucleotide
ctcatatgctatgttagaagtccaggc

SEQ ID NO: 1002 - DNA, 27 bp, Artificial Sequence
  Synthetic oligonucleotide
tcatatgctatgttagaagtccaggca

SEQ ID NO: 1003 - DNA, 27 bp, Artificial Sequence
  Synthetic oligonucleotide
catatgctatgttagaagtccaggcag

SEQ ID NO: 1004 - DNA, 27 bp, Artificial Sequence
  Synthetic oligonucleotide
atatgctatgttagaagtccaggcaga

SEQ ID NO: 1005 - DNA, 27 bp, Artificial Sequence
  Synthetic oligonucleotide
tgctatgttagaagtccaggcagagac

SEQ ID NO: 1006 - DNA, 27 bp, Artificial Sequence
  Synthetic oligonucleotide
ctatgttagaagtccaggcagagacaa

SEQ ID NO: 1007 - DNA, 27 bp, Artificial Sequence
  Synthetic oligonucleotide
tatgttagaagtccaggcagagacaat

SEQ ID NO: 1008 - DNA, 27 bp, Artificial Sequence
  Synthetic oligonucleotide
atgttagaagtccaggcagagacaata

SEQ ID NO: 1009 - DNA, 27 bp, Artificial Sequence
  Synthetic oligonucleotide
tgttagaagtccaggcagagacaataa

SEQ ID NO: 1010 - DNA, 27 bp, Artificial Sequence
  Synthetic oligonucleotide
gttagaagtccaggcagagacaataaa

SEQ ID NO: 1011 - DNA, 27 bp, Artificial Sequence
  Synthetic oligonucleotide
ttagaagtccaggcagagacaataaaa

SEQ ID NO: 1012 - DNA, 27 bp, Artificial Sequence
  Synthetic oligonucleotide
tagaagtccaggcagagacaataaaac

SEQ ID NO: 1013 - DNA, 27 bp, Artificial Sequence
  Synthetic oligonucleotide
agaagtccaggcagagacaataaaaca

SEQ ID NO: 1014 - DNA, 27 bp, Artificial Sequence
  Synthetic oligonucleotide
gaagtccaggcagagacaataaaacat

SEQ ID NO: 1015 - DNA, 27 bp, Artificial Sequence
  Synthetic oligonucleotide
aagtccaggcagagacaataaaacatt

SEQ ID NO: 1016 - DNA, 27 bp, Artificial Sequence
  Synthetic oligonucleotide
agtccaggcagagacaataaaacattc

SEQ ID NO: 1017 - DNA, 27 bp, Artificial Sequence
  Synthetic oligonucleotide
tccaggcagagacaataaaacattcct

SEQ ID NO: 1018 - DNA, 27 bp, Artificial Sequence
  Synthetic oligonucleotide
ccaggcagagacaataaaacattcctg

SEQ ID NO: 1019 - DNA, 27 bp, Artificial Sequence
  Synthetic oligonucleotide
caggcagagacaataaaacattcctgt

SEQ ID NO: 1020 - DNA, 27 bp, Artificial Sequence
  Synthetic oligonucleotide
aggcagagacaataaaacattcctgtg

SEQ ID NO: 1021 - DNA, 27 bp, Artificial Sequence
  Synthetic oligonucleotide
ggcagagacaataaaacattcctgtga

SEQ ID NO: 1022 - DNA, 27 bp, Artificial Sequence
  Synthetic oligonucleotide
gcagagacaataaaacattcctgtgaa

SEQ ID NO: 1023 - DNA, 27 bp, Artificial Sequence
  Synthetic oligonucleotide
cagagacaataaaacattcctgtgaaa

SEQ ID NO: 1024 - DNA, 27 bp, Artificial Sequence
  Synthetic oligonucleotide
agagacaataaaacattcctgtgaaag

SEQ ID NO: 1025 - DNA, 27 bp, Artificial Sequence
  Synthetic oligonucleotide
gagacaataaaacattcctgtgaaagg

SEQ ID NO: 1026 - DNA, 27 bp, Artificial Sequence
  Synthetic oligonucleotide
agacaataaaacattcctgtgaaaggc

SEQ ID NO: 1027 - DNA, 27 bp, Artificial Sequence
  Synthetic oligonucleotide
gacaataaaacattcctgtgaaaggca

SEQ ID NO: 1028 - DNA, 27 bp, Artificial Sequence
  Synthetic oligonucleotide
acaataaaacattcctgtgaaaggcac

SEQ ID NO: 1029 - DNA, 27 bp, Artificial Sequence
  Synthetic oligonucleotide
caataaaacattcctgtgaaaggcact

SEQ ID NO: 1030 - DNA, 27 bp, Artificial Sequence
  Synthetic oligonucleotide
taaaacattcctgtgaaaggcactttt

SEQ ID NO: 1031 - DNA, 27 bp, Artificial Sequence
  Synthetic oligonucleotide
aaaacattcctgtgaaaggcacttttc

SEQ ID NO: 1032 - DNA, 27 bp, Artificial Sequence
  Synthetic oligonucleotide
aaacattcctgtgaaaggcacttttca

SEQ ID NO: 1033 - DNA, 27 bp, Artificial Sequence
  Synthetic oligonucleotide
aacattcctgtgaaaggcacttttcat

SEQ ID NO: 1034 - DNA, 27 bp, Artificial Sequence
  Synthetic oligonucleotide
acattcctgtgaaaggcacttttcatt

SEQ ID NO: 1035 - DNA, 27 bp, Artificial Sequence
  Synthetic oligonucleotide
cattcctgtgaaaggcacttttcattc

SEQ ID NO: 1036 - DNA, 27 bp, Artificial Sequence
  Synthetic oligonucleotide
ttcctgtgaaaggcacttttcattcca

SEQ ID NO: 1037 - DNA, 27 bp, Artificial Sequence
  Synthetic oligonucleotide
tcctgtgaaaggcacttttcattccac

SEQ ID NO: 1038 - DNA, 27 bp, Artificial Sequence
  Synthetic oligonucleotide
cctgtgaaaggcacttttcattccact

SEQ ID NO: 1039 - DNA, 27 bp, Artificial Sequence
  Synthetic oligonucleotide
ctgtgaaaggcacttttcattccactt

SEQ ID NO: 1040 - DNA, 27 bp, Artificial Sequence
  Synthetic oligonucleotide
tgtgaaaggcacttttcattccacttt

SEQ ID NO: 1041 - DNA, 27 bp, Artificial Sequence
  Synthetic oligonucleotide
gtgaaaggcacttttcattccacttta

SEQ ID NO: 1042 - DNA, 27 bp, Artificial Sequence
  Synthetic oligonucleotide
tgaaaggcacttttcattccactttaa

SEQ ID NO: 1043 - DNA, 27 bp, Artificial Sequence
  Synthetic oligonucleotide
gaaaggcacttttcattccactttaac

SEQ ID NO: 1044 - DNA, 27 bp, Artificial Sequence
  Synthetic oligonucleotide
aaaggcacttttcattccactttaact

SEQ ID NO: 1045 - DNA, 27 bp, Artificial Sequence
  Synthetic oligonucleotide
aaggcacttttcattccactttaactt

SEQ ID NO: 1046 - DNA, 27 bp, Artificial Sequence
  Synthetic oligonucleotide
aggcacttttcattccactttaacttg

SEQ ID NO: 1047 - DNA, 27 bp, Artificial Sequence
  Synthetic oligonucleotide
ggcacttttcattccactttaacttga

SEQ ID NO: 1048 - DNA, 27 bp, Artificial Sequence
  Synthetic oligonucleotide
gcacttttcattccactttaacttgat

SEQ ID NO: 1049 - DNA, 27 bp, Artificial Sequence
  Synthetic oligonucleotide
cacttttcattccactttaacttgatt

SEQ ID NO: 1050 - DNA, 27 bp, Artificial Sequence
  Synthetic oligonucleotide
acttttcattccactttaacttgattt

SEQ ID NO: 1051 - DNA, 27 bp, Artificial Sequence
  Synthetic oligonucleotide
cttttcattccactttaacttgatttt

SEQ ID NO: 1052 - DNA, 27 bp, Artificial Sequence
  Synthetic oligonucleotide
ttttcattccactttaacttgattttt

SEQ ID NO: 1053 - DNA, 27 bp, Artificial Sequence
  Synthetic oligonucleotide
tttcattccactttaacttgatttttt

SEQ ID NO: 1054 - DNA, 27 bp, Artificial Sequence
  Synthetic oligonucleotide
ttcattccactttaacttgatttttta

SEQ ID NO: 1055 - DNA, 27 bp, Artificial Sequence
  Synthetic oligonucleotide
tcattccactttaacttgattttttaa

SEQ ID NO: 1056 - DNA, 27 bp, Artificial Sequence
  Synthetic oligonucleotide
cattccactttaacttgattttttaaa

SEQ ID NO: 1057 - DNA, 27 bp, Artificial Sequence
  Synthetic oligonucleotide
attccactttaacttgattttttaaat

SEQ ID NO: 1058 - DNA, 27 bp, Artificial Sequence
  Synthetic oligonucleotide
ttccactttaacttgattttttaaatt

SEQ ID NO: 1059 - DNA, 27 bp, Artificial Sequence
  Synthetic oligonucleotide
tccactttaacttgattttttaaattc

SEQ ID NO: 1060 - DNA, 27 bp, Artificial Sequence
  Synthetic oligonucleotide
ccactttaacttgattttttaaattcc

SEQ ID NO: 1061 - DNA, 27 bp, Artificial Sequence
  Synthetic oligonucleotide
cactttaacttgattttttaaattccc

SEQ ID NO: 1062 - DNA, 27 bp, Artificial Sequence
  Synthetic oligonucleotide
actttaacttgattttttaaattccct

SEQ ID NO: 1063 - DNA, 27 bp, Artificial Sequence
  Synthetic oligonucleotide
ctttaacttgattttttaaattccctt

SEQ ID NO: 1064 - DNA, 27 bp, Artificial Sequence
  Synthetic oligonucleotide
tttaacttgattttttaaattccctta

SEQ ID NO: 1065 - DNA, 27 bp, Artificial Sequence
  Synthetic oligonucleotide
ttaacttgattttttaaattcccttat

SEQ ID NO: 1066 - DNA, 27 bp, Artificial Sequence
  Synthetic oligonucleotide
taacttgattttttaaattcccttatt

SEQ ID NO: 1067 - DNA, 27 bp, Artificial Sequence
  Synthetic oligonucleotide
aacttgattttttaaattcccttattg

SEQ ID NO: 1068 - DNA, 27 bp, Artificial Sequence
  Synthetic oligonucleotide
acttgattttttaaattcccttattgt

SEQ ID NO: 1069 - DNA, 27 bp, Artificial Sequence
  Synthetic oligonucleotide
cttgattttttaaattcccttattgtc

SEQ ID NO: 1070 - DNA, 27 bp, Artificial Sequence
  Synthetic oligonucleotide
ttgattttttaaattcccttattgtcc

SEQ ID NO: 1071 - DNA, 27 bp, Artificial Sequence
  Synthetic oligonucleotide
tgattttttaaattcccttattgtccc

SEQ ID NO: 1072 - DNA, 27 bp, Artificial Sequence
  Synthetic oligonucleotide
attttttaaattcccttattgtccctt

SEQ ID NO: 1073 - DNA, 27 bp, Artificial Sequence
  Synthetic oligonucleotide
ttaaattcccttattgtcccttccaaa

SEQ ID NO: 1074 - DNA, 27 bp, Artificial Sequence
  Synthetic oligonucleotide
taaattcccttattgtcccttccaaaa

SEQ ID NO: 1075 - DNA, 27 bp, Artificial Sequence
  Synthetic oligonucleotide
attcccttattgtcccttccaaaaaaa

SEQ ID NO: 1076 - DNA, 27 bp, Artificial Sequence
  Synthetic oligonucleotide
aaaaaaagagaatcaaaattttacaaa

SEQ ID NO: 1077 - DNA, 27 bp, Artificial Sequence
  Synthetic oligonucleotide
aaaaaagagaatcaaaattttacaaag

SEQ ID NO: 1078 - DNA, 27 bp, Artificial Sequence
  Synthetic oligonucleotide
aaaaagagaatcaaaattttacaaaga

SEQ ID NO: 1079 - DNA, 27 bp, Artificial Sequence
  Synthetic oligonucleotide
aaaagagaatcaaaattttacaaagaa

SEQ ID NO: 1080 - DNA, 27 bp, Artificial Sequence
  Synthetic oligonucleotide
aaagagaatcaaaattttacaaagaat

SEQ ID NO: 1081 - DNA, 27 bp, Artificial Sequence
  Synthetic oligonucleotide
aagagaatcaaaattttacaaagaatc

SEQ ID NO: 1082 - DNA, 27 bp, Artificial Sequence
  Synthetic oligonucleotide
agagaatcaaaattttacaaagaatca

SEQ ID NO: 1083 - DNA, 27 bp, Artificial Sequence
  Synthetic oligonucleotide
gagaatcaaaattttacaaagaatcaa

SEQ ID NO: 1084 - DNA, 27 bp, Artificial Sequence
  Synthetic oligonucleotide
agaatcaaaattttacaaagaatcaaa

SEQ ID NO: 1085 - DNA, 27 bp, Artificial Sequence
  Synthetic oligonucleotide
gaatcaaaattttacaaagaatcaaag

SEQ ID NO: 1086 - DNA, 27 bp, Artificial Sequence
  Synthetic oligonucleotide
aatcaaaattttacaaagaatcaaagg

SEQ ID NO: 1087 - DNA, 27 bp, Artificial Sequence
  Synthetic oligonucleotide
atcaaaattttacaaagaatcaaagga

SEQ ID NO: 1088 - DNA, 27 bp, Artificial Sequence
  Synthetic oligonucleotide
tcaaaattttacaaagaatcaaaggaa

SEQ ID NO: 1089 - DNA, 27 bp, Artificial Sequence
  Synthetic oligonucleotide
caaaattttacaaagaatcaaaggaat

SEQ ID NO: 1090 - DNA, 27 bp, Artificial Sequence
  Synthetic oligonucleotide
aaaattttacaaagaatcaaaggaatt

SEQ ID NO: 1091 - DNA, 27 bp, Artificial Sequence
  Synthetic oligonucleotide
aattttacaaagaatcaaaggaattct

SEQ ID NO: 1092 - DNA, 27 bp, Artificial Sequence
  Synthetic oligonucleotide
attttacaaagaatcaaaggaattcta

SEQ ID NO: 1093 - DNA, 27 bp, Artificial Sequence
  Synthetic oligonucleotide
ttttacaaagaatcaaaggaattctag

SEQ ID NO: 1094 - DNA, 27 bp, Artificial Sequence
  Synthetic oligonucleotide
tttacaaagaatcaaaggaattctaga

SEQ ID NO: 1095 - DNA, 27 bp, Artificial Sequence
  Synthetic oligonucleotide
ttacaaagaatcaaaggaattctagaa

SEQ ID NO: 1096 - DNA, 27 bp, Artificial Sequence
  Synthetic oligonucleotide
tacaaagaatcaaaggaattctagaaa

SEQ ID NO: 1097 - DNA, 27 bp, Artificial Sequence
  Synthetic oligonucleotide
acaaagaatcaaaggaattctagaaag

SEQ ID NO: 1098 - DNA, 27 bp, Artificial Sequence
  Synthetic oligonucleotide
caaagaatcaaaggaattctagaaagt

SEQ ID NO: 1099 - DNA, 27 bp, Artificial Sequence
  Synthetic oligonucleotide
aaagaatcaaaggaattctagaaagta

SEQ ID NO: 1100 - DNA, 27 bp, Artificial Sequence
  Synthetic oligonucleotide
aagaatcaaaggaattctagaaagtat

SEQ ID NO: 1101 - DNA, 27 bp, Artificial Sequence
  Synthetic oligonucleotide
agaatcaaaggaattctagaaagtatc

SEQ ID NO: 1102 - DNA, 27 bp, Artificial Sequence
  Synthetic oligonucleotide
gaatcaaaggaattctagaaagtatct

SEQ ID NO: 1103 - DNA, 27 bp, Artificial Sequence
  Synthetic oligonucleotide
aatcaaaggaattctagaaagtatctg

SEQ ID NO: 1104 - DNA, 27 bp, Artificial Sequence
  Synthetic oligonucleotide
atcaaaggaattctagaaagtatctgg

SEQ ID NO: 1105 - DNA, 27 bp, Artificial Sequence
  Synthetic oligonucleotide
tcaaaggaattctagaaagtatctggg

SEQ ID NO: 1106 - DNA, 27 bp, Artificial Sequence
  Synthetic oligonucleotide
ctaggagagatccaaatttccattgtc

SEQ ID NO: 1107 - DNA, 27 bp, Artificial Sequence
  Synthetic oligonucleotide
taggagagatccaaatttccattgtct

SEQ ID NO: 1108 - DNA, 27 bp, Artificial Sequence
  Synthetic oligonucleotide
gagagatccaaatttccattgtcttgc

SEQ ID NO: 1109 - DNA, 27 bp, Artificial Sequence
  Synthetic oligonucleotide
agagatccaaatttccattgtcttgca

SEQ ID NO: 1110 - DNA, 27 bp, Artificial Sequence
  Synthetic oligonucleotide
gagatccaaatttccattgtcttgcaa

SEQ ID NO: 1111 - DNA, 27 bp, Artificial Sequence
  Synthetic oligonucleotide
agatccaaatttccattgtcttgcaag

SEQ ID NO: 1112 - DNA, 27 bp, Artificial Sequence
  Synthetic oligonucleotide
gatccaaatttccattgtcttgcaagc

SEQ ID NO: 1113 - DNA, 27 bp, Artificial Sequence
  Synthetic oligonucleotide
atccaaatttccattgtcttgcaagca

SEQ ID NO: 1114 - DNA, 27 bp, Artificial Sequence
  Synthetic oligonucleotide
tccaaatttccattgtcttgcaagcaa

SEQ ID NO: 1115 - DNA, 27 bp, Artificial Sequence
  Synthetic oligonucleotide
ccaaatttccattgtcttgcaagcaaa

SEQ ID NO: 1116 - DNA, 27 bp, Artificial Sequence
  Synthetic oligonucleotide
caaatttccattgtcttgcaagcaaag

SEQ ID NO: 1117 - DNA, 27 bp, Artificial Sequence
  Synthetic oligonucleotide
aaatttccattgtcttgcaagcaaagc

SEQ ID NO: 1118 - DNA, 27 bp, Artificial Sequence
  Synthetic oligonucleotide
aatttccattgtcttgcaagcaaagca

SEQ ID NO: 1119 - DNA, 27 bp, Artificial Sequence
  Synthetic oligonucleotide
atttccattgtcttgcaagcaaagcac

SEQ ID NO: 1120 - DNA, 27 bp, Artificial Sequence
  Synthetic oligonucleotide
tttccattgtcttgcaagcaaagcacg

SEQ ID NO: 1121 - DNA, 27 bp, Artificial Sequence
  Synthetic oligonucleotide
ttccattgtcttgcaagcaaagcacgt

SEQ ID NO: 1122 - DNA, 27 bp, Artificial Sequence
  Synthetic oligonucleotide
tccattgtcttgcaagcaaagcacgta

SEQ ID NO: 1123 - DNA, 27 bp, Artificial Sequence
  Synthetic oligonucleotide
ccattgtcttgcaagcaaagcacgtat

SEQ ID NO: 1124 - DNA, 27 bp, Artificial Sequence
  Synthetic oligonucleotide
cattgtcttgcaagcaaagcacgtatt

SEQ ID NO: 1125 - DNA, 27 bp, Artificial Sequence
  Synthetic oligonucleotide
attgtcttgcaagcaaagcacgtatta

SEQ ID NO: 1126 - DNA, 27 bp, Artificial Sequence
  Synthetic oligonucleotide
ttgtcttgcaagcaaagcacgtattaa

SEQ ID NO: 1127 - DNA, 27 bp, Artificial Sequence
  Synthetic oligonucleotide
tgtcttgcaagcaaagcacgtattaaa

SEQ ID NO: 1128 - DNA, 27 bp, Artificial Sequence
  Synthetic oligonucleotide
gtcttgcaagcaaagcacgtattaaat

SEQ ID NO: 1129 - DNA, 27 bp, Artificial Sequence
  Synthetic oligonucleotide
tcttgcaagcaaagcacgtattaaata

SEQ ID NO: 1130 - DNA, 27 bp, Artificial Sequence
  Synthetic oligonucleotide
cttgcaagcaaagcacgtattaaatat

SEQ ID NO: 1131 - DNA, 27 bp, Artificial Sequence
  Synthetic oligonucleotide
ttgcaagcaaagcacgtattaaatatg

SEQ ID NO: 1132 - DNA, 27 bp, Artificial Sequence
  Synthetic oligonucleotide
tgcaagcaaagcacgtattaaatatga

SEQ ID NO: 1133 - DNA, 27 bp, Artificial Sequence
  Synthetic oligonucleotide
gcaagcaaagcacgtattaaatatgat

SEQ ID NO: 1134 - DNA, 27 bp, Artificial Sequence
  Synthetic oligonucleotide
caagcaaagcacgtattaaatatgatc

SEQ ID NO: 1135 - DNA, 27 bp, Artificial Sequence
  Synthetic oligonucleotide
aagcaaagcacgtattaaatatgatct

SEQ ID NO: 1136 - DNA, 27 bp, Artificial Sequence
  Synthetic oligonucleotide
agcaaagcacgtattaaatatgatctg

SEQ ID NO: 1137 - DNA, 27 bp, Artificial Sequence
  Synthetic oligonucleotide
gcaaagcacgtattaaatatgatctgc

SEQ ID NO: 1138 - DNA, 27 bp, Artificial Sequence
  Synthetic oligonucleotide
caaagcacgtattaaatatgatctgca

SEQ ID NO: 1139 - DNA, 27 bp, Artificial Sequence
  Synthetic oligonucleotide
aaagcacgtattaaatatgatctgcag

SEQ ID NO: 1140 - DNA, 27 bp, Artificial Sequence
  Synthetic oligonucleotide
aagcacgtattaaatatgatctgcagc

SEQ ID NO: 1141 - DNA, 27 bp, Artificial Sequence
  Synthetic oligonucleotide
agcacgtattaaatatgatctgcagcc

SEQ ID NO: 1142 - DNA, 27 bp, Artificial Sequence
  Synthetic oligonucleotide
cacgtattaaatatgatctgcagccat

SEQ ID NO: 1143 - DNA, 27 bp, Artificial Sequence
  Synthetic oligonucleotide
acgtattaaatatgatctgcagccatt

SEQ ID NO: 1144 - DNA, 27 bp, Artificial Sequence
  Synthetic oligonucleotide
gtattaaatatgatctgcagccattaa

SEQ ID NO: 1145 - DNA, 27 bp, Artificial Sequence
  Synthetic oligonucleotide
tattaaatatgatctgcagccattaaa

SEQ ID NO: 1146 - DNA, 27 bp, Artificial Sequence
  Synthetic oligonucleotide
attaaatatgatctgcagccattaaaa

SEQ ID NO: 1147 - DNA, 27 bp, Artificial Sequence
  Synthetic oligonucleotide
ttaaatatgatctgcagccattaaaaa

SEQ ID NO: 1148 - DNA, 27 bp, Artificial Sequence
  Synthetic oligonucleotide
taaatatgatctgcagccattaaaaag

SEQ ID NO: 1149 - DNA, 27 bp, Artificial Sequence
  Synthetic oligonucleotide
aaatatgatctgcagccattaaaaaga

SEQ ID NO: 1150 - DNA, 27 bp, Artificial Sequence
  Synthetic oligonucleotide
aatatgatctgcagccattaaaaagac

SEQ ID NO: 1151 - DNA, 27 bp, Artificial Sequence
  Synthetic oligonucleotide
atatgatctgcagccattaaaaagaca

SEQ ID NO: 1152 - DNA, 27 bp, Artificial Sequence
  Synthetic oligonucleotide
tatgatctgcagccattaaaaagacac

SEQ ID NO: 1153 - RNA, 25 nt, Artificial Sequence
  Synthetic oligonucleotide
ugacuaagucaauaaucagaaucag

SEQ ID NO: 1154 - RNA, 25 nt, Artificial Sequence
  Synthetic oligonucleotide
gacuaagucaauaaucagaaucagc

SEQ ID NO: 1155 - RNA, 25 nt, Artificial Sequence
  Synthetic oligonucleotide
acuaagucaauaaucagaaucagca

SEQ ID NO: 1156 - RNA, 25 nt, Artificial Sequence
  Synthetic oligonucleotide
cuaagucaauaaucagaaucagcag

SEQ ID NO: 1157 - RNA, 25 nt, Artificial Sequence
  Synthetic oligonucleotide
uaagucaauaaucagaaucagcagg

SEQ ID NO: 1158 - RNA, 25 nt, Artificial Sequence
  Synthetic oligonucleotide
aagucaauaaucagaaucagcaggu

SEQ ID NO: 1159 - RNA, 25 nt, Artificial Sequence
  Synthetic oligonucleotide
agucaauaaucagaaucagcagguu

SEQ ID NO: 1160 - RNA, 25 nt, Artificial Sequence
  Synthetic oligonucleotide
gucaauaaucagaaucagcagguuu

SEQ ID NO: 1161 - RNA, 25 nt, Artificial Sequence
  Synthetic oligonucleotide
ucaauaaucagaaucagcagguuug

SEQ ID NO: 1162 - RNA, 25 nt, Artificial Sequence
  Synthetic oligonucleotide
caauaaucagaaucagcagguuugc

SEQ ID NO: 1163 - RNA, 25 nt, Artificial Sequence
  Synthetic oligonucleotide
aauaaucagaaucagcagguuugca

SEQ ID NO: 1164 - RNA, 25 nt, Artificial Sequence
  Synthetic oligonucleotide
auaaucagaaucagcagguuugcag

SEQ ID NO: 1165 - RNA, 25 nt, Artificial Sequence
  Synthetic oligonucleotide
uaaucagaaucagcagguuugcagu

SEQ ID NO: 1166 - RNA, 25 nt, Artificial Sequence
  Synthetic oligonucleotide
aaucagaaucagcagguuugcaguc

SEQ ID NO: 1167 - RNA, 25 nt, Artificial Sequence
  Synthetic oligonucleotide
aucagaaucagcagguuugcaguca

SEQ ID NO: 1168 - RNA, 25 nt, Artificial Sequence
  Synthetic oligonucleotide
cagaaucagcagguuugcagucaga

SEQ ID NO: 1169 - RNA, 25 nt, Artificial Sequence
  Synthetic oligonucleotide
agaaucagcagguuugcagucagau

SEQ ID NO: 1170 - RNA, 25 nt, Artificial Sequence
  Synthetic oligonucleotide
aaucagcagguuugcagucagauug

SEQ ID NO: 1171 - RNA, 25 nt, Artificial Sequence
  Synthetic oligonucleotide
aucagcagguuugcagucagauugg

SEQ ID NO: 1172 - RNA, 25 nt, Artificial Sequence
  Synthetic oligonucleotide
gcagucagauuggcagggauaagca

SEQ ID NO: 1173 - RNA, 25 nt, Artificial Sequence
  Synthetic oligonucleotide
gccuagcucaggagaagugaguaua

SEQ ID NO: 1174 - RNA, 25 nt, Artificial Sequence
  Synthetic oligonucleotide
uagcucaggagaagugaguauaaaa

SEQ ID NO: 1175 - RNA, 25 nt, Artificial Sequence
  Synthetic oligonucleotide
agcucaggagaagugaguauaaaag

SEQ ID NO: 1176 - RNA, 25 nt, Artificial Sequence
  Synthetic oligonucleotide
gcucaggagaagugaguauaaaagc

SEQ ID NO: 1177 - RNA, 25 nt, Artificial Sequence
  Synthetic oligonucleotide
cucaggagaagugaguauaaaagcc

SEQ ID NO: 1178 - RNA, 25 nt, Artificial Sequence
  Synthetic oligonucleotide
caggagaagugaguauaaaagcccc

SEQ ID NO: 1179 - RNA, 25 nt, Artificial Sequence
  Synthetic oligonucleotide
gcagccaucacagaaguccacucau

SEQ ID NO: 1180 - RNA, 25 nt, Artificial Sequence
  Synthetic oligonucleotide
cagccaucacagaaguccacucauu

SEQ ID NO: 1181 - RNA, 25 nt, Artificial Sequence
  Synthetic oligonucleotide
agccaucacagaaguccacucauuc

SEQ ID NO: 1182 - RNA, 25 nt, Artificial Sequence
  Synthetic oligonucleotide
gccaucacagaaguccacucauucu

SEQ ID NO: 1183 - RNA, 25 nt, Artificial Sequence
  Synthetic oligonucleotide
ccaucacagaaguccacucauucuu

SEQ ID NO: 1184 - RNA, 25 nt, Artificial Sequence
  Synthetic oligonucleotide
caucacagaaguccacucauucuug

SEQ ID NO: 1185 - RNA, 25 nt, Artificial Sequence
  Synthetic oligonucleotide
aucacagaaguccacucauucuugg

SEQ ID NO: 1186 - RNA, 25 nt, Artificial Sequence
  Synthetic oligonucleotide
cacagaaguccacucauucuuggca

SEQ ID NO: 1187 - RNA, 25 nt, Artificial Sequence
  Synthetic oligonucleotide
acagaaguccacucauucuuggcag

SEQ ID NO: 1188 - RNA, 25 nt, Artificial Sequence
  Synthetic oligonucleotide
uucuuggcaggauggcuucucaucg

SEQ ID NO: 1189 - RNA, 25 nt, Artificial Sequence
  Synthetic oligonucleotide
ucuuggcaggauggcuucucaucgu

SEQ ID NO: 1190 - RNA, 25 nt, Artificial Sequence
  Synthetic oligonucleotide
cuuggcaggauggcuucucaucguc

SEQ ID NO: 1191 - RNA, 25 nt, Artificial Sequence
  Synthetic oligonucleotide
uuggcaggauggcuucucaucgucu

SEQ ID NO: 1192 - RNA, 25 nt, Artificial Sequence
  Synthetic oligonucleotide
uggcaggauggcuucucaucgucug

SEQ ID NO: 1193 - RNA, 25 nt, Artificial Sequence
  Synthetic oligonucleotide
ggcaggauggcuucucaucgucugc

SEQ ID NO: 1194 - RNA, 25 nt, Artificial Sequence
  Synthetic oligonucleotide
gcaggauggcuucucaucgucugcu

SEQ ID NO: 1195 - RNA, 25 nt, Artificial Sequence
  Synthetic oligonucleotide
caggauggcuucucaucgucugcuc

SEQ ID NO: 1196 - RNA, 25 nt, Artificial Sequence
  Synthetic oligonucleotide
aggauggcuucucaucgucugcucc

SEQ ID NO: 1197 - RNA, 25 nt, Artificial Sequence
  Synthetic oligonucleotide
ggauggcuucucaucgucugcuccu

SEQ ID NO: 1198 - RNA, 25 nt, Artificial Sequence
  Synthetic oligonucleotide
gauggcuucucaucgucugcuccuc

SEQ ID NO: 1199 - RNA, 25 nt, Artificial Sequence
  Synthetic oligonucleotide
auggcuucucaucgucugcuccucc

SEQ ID NO: 1200 - RNA, 25 nt, Artificial Sequence
  Synthetic oligonucleotide
uggcuucucaucgucugcuccuccu

SEQ ID NO: 1201 - RNA, 25 nt, Artificial Sequence
  Synthetic oligonucleotide
ggcuucucaucgucugcuccuccuc

SEQ ID NO: 1202 - RNA, 25 nt, Artificial Sequence
  Synthetic oligonucleotide
gcuucucaucgucugcuccuccucu

SEQ ID NO: 1203 - RNA, 25 nt, Artificial Sequence
  Synthetic oligonucleotide
cuucucaucgucugcuccuccucug

SEQ ID NO: 1204 - RNA, 25 nt, Artificial Sequence
  Synthetic oligonucleotide
ucugccuugcuggacugguauuugu

SEQ ID NO: 1205 - RNA, 25 nt, Artificial Sequence
  Synthetic oligonucleotide
cugccuugcuggacugguauuugug

SEQ ID NO: 1206 - RNA, 25 nt, Artificial Sequence
  Synthetic oligonucleotide
ccggugaauccaaguguccucugau

SEQ ID NO: 1207 - RNA, 25 nt, Artificial Sequence
  Synthetic oligonucleotide
ugaauccaaguguccucugaugguc

SEQ ID NO: 1208 - RNA, 25 nt, Artificial Sequence
  Synthetic oligonucleotide
gaauccaaguguccucugaugguca

SEQ ID NO: 1209 - RNA, 25 nt, Artificial Sequence
  Synthetic oligonucleotide
aauccaaguguccucugauggucaa

SEQ ID NO: 1210 - RNA, 25 nt, Artificial Sequence
  Synthetic oligonucleotide
auccaaguguccucugauggucaaa

SEQ ID NO: 1211 - RNA, 25 nt, Artificial Sequence
  Synthetic oligonucleotide
uccaaguguccucugauggucaaag

SEQ ID NO: 1212 - RNA, 25 nt, Artificial Sequence
  Synthetic oligonucleotide
ccaaguguccucugauggucaaagu

SEQ ID NO: 1213 - RNA, 25 nt, Artificial Sequence
  Synthetic oligonucleotide
caaguguccucugauggucaaaguu

SEQ ID NO: 1214 - RNA, 25 nt, Artificial Sequence
  Synthetic oligonucleotide
aaguguccucugauggucaaaguuc

SEQ ID NO: 1215 - RNA, 25 nt, Artificial Sequence
  Synthetic oligonucleotide
aguguccucugauggucaaaguucu

SEQ ID NO: 1216 - RNA, 25 nt, Artificial Sequence
  Synthetic oligonucleotide
guguccucugauggucaaaguucua

SEQ ID NO: 1217 - RNA, 25 nt, Artificial Sequence
  Synthetic oligonucleotide
uguccucugauggucaaaguucuag

SEQ ID NO: 1218 - RNA, 25 nt, Artificial Sequence
  Synthetic oligonucleotide
guccucugauggucaaaguucuaga

SEQ ID NO: 1219 - RNA, 25 nt, Artificial Sequence
  Synthetic oligonucleotide
uccucugauggucaaaguucuagau

SEQ ID NO: 1220 - RNA, 25 nt, Artificial Sequence
  Synthetic oligonucleotide
ccucugauggucaaaguucuagaug

SEQ ID NO: 1221 - RNA, 25 nt, Artificial Sequence
  Synthetic oligonucleotide
cucugauggucaaaguucuagaugc

SEQ ID NO: 1222 - RNA, 25 nt, Artificial Sequence
  Synthetic oligonucleotide
ucugauggucaaaguucuagaugcu

SEQ ID NO: 1223 - RNA, 25 nt, Artificial Sequence
  Synthetic oligonucleotide
cugauggucaaaguucuagaugcug

SEQ ID NO: 1224 - RNA, 25 nt, Artificial Sequence
  Synthetic oligonucleotide
ugauggucaaaguucuagaugcugu

SEQ ID NO: 1225 - RNA, 25 nt, Artificial Sequence
  Synthetic oligonucleotide
gauggucaaaguucuagaugcuguc

SEQ ID NO: 1226 - RNA, 25 nt, Artificial Sequence
  Synthetic oligonucleotide
auggucaaaguucuagaugcugucc

SEQ ID NO: 1227 - RNA, 25 nt, Artificial Sequence
  Synthetic oligonucleotide
uggucaaaguucuagaugcuguccg

SEQ ID NO: 1228 - RNA, 25 nt, Artificial Sequence
  Synthetic oligonucleotide
gccauuugccucugggaaaaccagu

SEQ ID NO: 1229 - RNA, 25 nt, Artificial Sequence
  Synthetic oligonucleotide
ccauuugccucugggaaaaccagug

SEQ ID NO: 1230 - RNA, 25 nt, Artificial Sequence
  Synthetic oligonucleotide
cauuugccucugggaaaaccaguga

SEQ ID NO: 1231 - RNA, 25 nt, Artificial Sequence
  Synthetic oligonucleotide
auuugccucugggaaaaccagugag

SEQ ID NO: 1232 - RNA, 25 nt, Artificial Sequence
  Synthetic oligonucleotide
uuugccucugggaaaaccagugagu

SEQ ID NO: 1233 - RNA, 25 nt, Artificial Sequence
  Synthetic oligonucleotide
uugccucugggaaaaccagugaguc

SEQ ID NO: 1234 - RNA, 25 nt, Artificial Sequence
  Synthetic oligonucleotide
ugccucugggaaaaccagugagucu

SEQ ID NO: 1235 - RNA, 25 nt, Artificial Sequence
  Synthetic oligonucleotide
gccucugggaaaaccagugagucug

SEQ ID NO: 1236 - RNA, 25 nt, Artificial Sequence
  Synthetic oligonucleotide
ccucugggaaaaccagugagucugg

SEQ ID NO: 1237 - RNA, 25 nt, Artificial Sequence
  Synthetic oligonucleotide
cucugggaaaaccagugagucugga

SEQ ID NO: 1238 - RNA, 25 nt, Artificial Sequence
  Synthetic oligonucleotide
ucugggaaaaccagugagucuggag

SEQ ID NO: 1239 - RNA, 25 nt, Artificial Sequence
  Synthetic oligonucleotide
cugggaaaaccagugagucuggaga

SEQ ID NO: 1240 - RNA, 25 nt, Artificial Sequence
  Synthetic oligonucleotide
ugggaaaaccagugagucuggagag

SEQ ID NO: 1241 - RNA, 25 nt, Artificial Sequence
  Synthetic oligonucleotide
gggaaaaccagugagucuggagagc

SEQ ID NO: 1242 - RNA, 25 nt, Artificial Sequence
  Synthetic oligonucleotide
ggaaaaccagugagucuggagagcu

SEQ ID NO: 1243 - RNA, 25 nt, Artificial Sequence
  Synthetic oligonucleotide
gaaaaccagugagucuggagagcug

SEQ ID NO: 1244 - RNA, 25 nt, Artificial Sequence
  Synthetic oligonucleotide
agcugcaugggcucacaacugagga

SEQ ID NO: 1245 - RNA, 25 nt, Artificial Sequence
  Synthetic oligonucleotide
gcugcaugggcucacaacugaggag

SEQ ID NO: 1246 - RNA, 25 nt, Artificial Sequence
  Synthetic oligonucleotide
cugcaugggcucacaacugaggagg

SEQ ID NO: 1247 - RNA, 25 nt, Artificial Sequence
  Synthetic oligonucleotide
ugcaugggcucacaacugaggagga

SEQ ID NO: 1248 - RNA, 25 nt, Artificial Sequence
  Synthetic oligonucleotide
gcaugggcucacaacugaggaggaa

SEQ ID NO: 1249 - RNA, 25 nt, Artificial Sequence
  Synthetic oligonucleotide
caugggcucacaacugaggaggaau

SEQ ID NO: 1250 - RNA, 25 nt, Artificial Sequence
  Synthetic oligonucleotide
augggcucacaacugaggaggaauu

SEQ ID NO: 1251 - RNA, 25 nt, Artificial Sequence
  Synthetic oligonucleotide
ugggcucacaacugaggaggaauuu

SEQ ID NO: 1252 - RNA, 25 nt, Artificial Sequence
  Synthetic oligonucleotide
gggcucacaacugaggaggaauuug

SEQ ID NO: 1253 - RNA, 25 nt, Artificial Sequence
  Synthetic oligonucleotide
ggcucacaacugaggaggaauuugu

SEQ ID NO: 1254 - RNA, 25 nt, Artificial Sequence
  Synthetic oligonucleotide
gcucacaacugaggaggaauuugua

SEQ ID NO: 1255 - RNA, 25 nt, Artificial Sequence
  Synthetic oligonucleotide
cucacaacugaggaggaauuuguag

SEQ ID NO: 1256 - RNA, 25 nt, Artificial Sequence
  Synthetic oligonucleotide
ucacaacugaggaggaauuuguaga

SEQ ID NO: 1257 - RNA, 25 nt, Artificial Sequence
  Synthetic oligonucleotide
cacaacugaggaggaauuuguagaa

SEQ ID NO: 1258 - RNA, 25 nt, Artificial Sequence
  Synthetic oligonucleotide
acaacugaggaggaauuuguagaag

SEQ ID NO: 1259 - RNA, 25 nt, Artificial Sequence
  Synthetic oligonucleotide
caacugaggaggaauuuguagaagg

SEQ ID NO: 1260 - RNA, 25 nt, Artificial Sequence
  Synthetic oligonucleotide
acugaggaggaauuuguagaaggga

SEQ ID NO: 1261 - RNA, 25 nt, Artificial Sequence
  Synthetic oligonucleotide
cugaggaggaauuuguagaagggau

SEQ ID NO: 1262 - RNA, 25 nt, Artificial Sequence
  Synthetic oligonucleotide
ugaggaggaauuuguagaagggaua

SEQ ID NO: 1263 - RNA, 25 nt, Artificial Sequence
  Synthetic oligonucleotide
gaggaggaauuuguagaagggauau

SEQ ID NO: 1264 - RNA, 25 nt, Artificial Sequence
  Synthetic oligonucleotide
aggaggaauuuguagaagggauaua

SEQ ID NO: 1265 - RNA, 25 nt, Artificial Sequence
  Synthetic oligonucleotide
ggaggaauuuguagaagggauauac

SEQ ID NO: 1266 - RNA, 25 nt, Artificial Sequence
  Synthetic oligonucleotide
gaggaauuuguagaagggauauaca

SEQ ID NO: 1267 - RNA, 25 nt, Artificial Sequence
  Synthetic oligonucleotide
aggaauuuguagaagggauauacaa

SEQ ID NO: 1268 - RNA, 25 nt, Artificial Sequence
  Synthetic oligonucleotide
ggaauuuguagaagggauauacaaa

SEQ ID NO: 1269 - RNA, 25 nt, Artificial Sequence
  Synthetic oligonucleotide
gaauuuguagaagggauauacaaag

SEQ ID NO: 1270 - RNA, 25 nt, Artificial Sequence
  Synthetic oligonucleotide
aauuuguagaagggauauacaaagu

SEQ ID NO: 1271 - RNA, 25 nt, Artificial Sequence
  Synthetic oligonucleotide
auuuguagaagggauauacaaagug

SEQ ID NO: 1272 - RNA, 25 nt, Artificial Sequence
  Synthetic oligonucleotide
uuuguagaagggauauacaaagugg

SEQ ID NO: 1273 - RNA, 25 nt, Artificial Sequence
  Synthetic oligonucleotide
uuguagaagggauauacaaagugga

SEQ ID NO: 1274 - RNA, 25 nt, Artificial Sequence
  Synthetic oligonucleotide
uguagaagggauauacaaaguggaa

SEQ ID NO: 1275 - RNA, 25 nt, Artificial Sequence
  Synthetic oligonucleotide
guagaagggauauacaaaguggaaa

SEQ ID NO: 1276 - RNA, 25 nt, Artificial Sequence
  Synthetic oligonucleotide
uagaagggauauacaaaguggaaau

SEQ ID NO: 1277 - RNA, 25 nt, Artificial Sequence
  Synthetic oligonucleotide
agaagggauauacaaaguggaaaua

SEQ ID NO: 1278 - RNA, 25 nt, Artificial Sequence
  Synthetic oligonucleotide
gaagggauauacaaaguggaaauag

SEQ ID NO: 1279 - RNA, 25 nt, Artificial Sequence
  Synthetic oligonucleotide
aagggauauacaaaguggaaauaga

SEQ ID NO: 1280 - RNA, 25 nt, Artificial Sequence
  Synthetic oligonucleotide
agggauauacaaaguggaaauagac

SEQ ID NO: 1281 - RNA, 25 nt, Artificial Sequence
  Synthetic oligonucleotide
gggauauacaaaguggaaauagaca

SEQ ID NO: 1282 - RNA, 25 nt, Artificial Sequence
  Synthetic oligonucleotide
ggauauacaaaguggaaauagacac

SEQ ID NO: 1283 - RNA, 25 nt, Artificial Sequence
  Synthetic oligonucleotide
gauauacaaaguggaaauagacacc

SEQ ID NO: 1284 - RNA, 25 nt, Artificial Sequence
  Synthetic oligonucleotide
auauacaaaguggaaauagacacca

SEQ ID NO: 1285 - RNA, 25 nt, Artificial Sequence
  Synthetic oligonucleotide
uauacaaaguggaaauagacaccaa

SEQ ID NO: 1286 - RNA, 25 nt, Artificial Sequence
  Synthetic oligonucleotide
auacaaaguggaaauagacaccaaa

SEQ ID NO: 1287 - RNA, 25 nt, Artificial Sequence
  Synthetic oligonucleotide
uacaaaguggaaauagacaccaaau

SEQ ID NO: 1288 - RNA, 25 nt, Artificial Sequence
  Synthetic oligonucleotide
acaaaguggaaauagacaccaaauc

SEQ ID NO: 1289 - RNA, 25 nt, Artificial Sequence
  Synthetic oligonucleotide
caaaguggaaauagacaccaaaucu

SEQ ID NO: 1290 - RNA, 25 nt, Artificial Sequence
  Synthetic oligonucleotide
aaaguggaaauagacaccaaaucuu

SEQ ID NO: 1291 - RNA, 25 nt, Artificial Sequence
  Synthetic oligonucleotide
aaguggaaauagacaccaaaucuua

SEQ ID NO: 1292 - RNA, 25 nt, Artificial Sequence
  Synthetic oligonucleotide
aguggaaauagacaccaaaucuuac

SEQ ID NO: 1293 - RNA, 25 nt, Artificial Sequence
  Synthetic oligonucleotide
guggaaauagacaccaaaucuuacu

SEQ ID NO: 1294 - RNA, 25 nt, Artificial Sequence
  Synthetic oligonucleotide
uggaaauagacaccaaaucuuacug

SEQ ID NO: 1295 - RNA, 25 nt, Artificial Sequence
  Synthetic oligonucleotide
ggaaauagacaccaaaucuuacugg

SEQ ID NO: 1296 - RNA, 25 nt, Artificial Sequence
  Synthetic oligonucleotide
gaaauagacaccaaaucuuacugga

SEQ ID NO: 1297 - RNA, 25 nt, Artificial Sequence
  Synthetic oligonucleotide
aaauagacaccaaaucuuacuggaa

SEQ ID NO: 1298 - RNA, 25 nt, Artificial Sequence
  Synthetic oligonucleotide
aauagacaccaaaucuuacuggaag

SEQ ID NO: 1299 - RNA, 25 nt, Artificial Sequence
  Synthetic oligonucleotide
auagacaccaaaucuuacuggaagg

SEQ ID NO: 1300 - RNA, 25 nt, Artificial Sequence
  Synthetic oligonucleotide
agacaccaaaucuuacuggaaggca

SEQ ID NO: 1301 - RNA, 25 nt, Artificial Sequence
  Synthetic oligonucleotide
gacaccaaaucuuacuggaaggcac

SEQ ID NO: 1302 - RNA, 25 nt, Artificial Sequence
  Synthetic oligonucleotide
cacuuggcaucuccccauuccauga

SEQ ID NO: 1303 - RNA, 25 nt, Artificial Sequence
  Synthetic oligonucleotide
acuuggcaucuccccauuccaugag

SEQ ID NO: 1304 - RNA, 25 nt, Artificial Sequence
  Synthetic oligonucleotide
cuuggcaucuccccauuccaugagc

SEQ ID NO: 1305 - RNA, 25 nt, Artificial Sequence
  Synthetic oligonucleotide
uuggcaucuccccauuccaugagca

SEQ ID NO: 1306 - RNA, 25 nt, Artificial Sequence
  Synthetic oligonucleotide
uggcaucuccccauuccaugagcau

SEQ ID NO: 1307 - RNA, 25 nt, Artificial Sequence
  Synthetic oligonucleotide
ggcaucuccccauuccaugagcaug

SEQ ID NO: 1308 - RNA, 25 nt, Artificial Sequence
  Synthetic oligonucleotide
gcaucuccccauuccaugagcaugc

SEQ ID NO: 1309 - RNA, 25 nt, Artificial Sequence
  Synthetic oligonucleotide
caucuccccauuccaugagcaugca

SEQ ID NO: 1310 - RNA, 25 nt, Artificial Sequence
  Synthetic oligonucleotide
aucuccccauuccaugagcaugcag

SEQ ID NO: 1311 - RNA, 25 nt, Artificial Sequence
  Synthetic oligonucleotide
ucuccccauuccaugagcaugcaga

SEQ ID NO: 1312 - RNA, 25 nt, Artificial Sequence
  Synthetic oligonucleotide
cuccccauuccaugagcaugcagag

SEQ ID NO: 1313 - RNA, 25 nt, Artificial Sequence
  Synthetic oligonucleotide
uccccauuccaugagcaugcagagg

SEQ ID NO: 1314 - RNA, 25 nt, Artificial Sequence
  Synthetic oligonucleotide
ccccauuccaugagcaugcagaggu

SEQ ID NO: 1315 - RNA, 25 nt, Artificial Sequence
  Synthetic oligonucleotide
caugagcaugcagaggugguauuca

SEQ ID NO: 1316 - RNA, 25 nt, Artificial Sequence
  Synthetic oligonucleotide
augagcaugcagaggugguauucac

SEQ ID NO: 1317 - RNA, 25 nt, Artificial Sequence
  Synthetic oligonucleotide
ugagcaugcagaggugguauucaca

SEQ ID NO: 1318 - RNA, 25 nt, Artificial Sequence
  Synthetic oligonucleotide
gagcaugcagaggugguauucacag

SEQ ID NO: 1319 - RNA, 25 nt, Artificial Sequence
  Synthetic oligonucleotide
augcagaggugguauucacagccaa

SEQ ID NO: 1320 - RNA, 25 nt, Artificial Sequence
  Synthetic oligonucleotide
agaggugguauucacagccaacgac

SEQ ID NO: 1321 - RNA, 25 nt, Artificial Sequence
  Synthetic oligonucleotide
gaggugguauucacagccaacgacu

SEQ ID NO: 1322 - RNA, 25 nt, Artificial Sequence
  Synthetic oligonucleotide
gucgucaccaaucccaaggaaugag

SEQ ID NO: 1323 - RNA, 25 nt, Artificial Sequence
  Synthetic oligonucleotide
ggacgagggaugggauuucauguaa

SEQ ID NO: 1324 - RNA, 25 nt, Artificial Sequence
  Synthetic oligonucleotide
gacgagggaugggauuucauguaac

SEQ ID NO: 1325 - RNA, 25 nt, Artificial Sequence
  Synthetic oligonucleotide
gagggaugggauuucauguaaccaa

SEQ ID NO: 1326 - RNA, 25 nt, Artificial Sequence
  Synthetic oligonucleotide
agggaugggauuucauguaaccaag

SEQ ID NO: 1327 - RNA, 25 nt, Artificial Sequence
  Synthetic oligonucleotide
gggaugggauuucauguaaccaaga

SEQ ID NO: 1328 - RNA, 25 nt, Artificial Sequence
  Synthetic oligonucleotide
gaugggauuucauguaaccaagagu

SEQ ID NO: 1329 - RNA, 25 nt, Artificial Sequence
  Synthetic oligonucleotide
augggauuucauguaaccaagagua

SEQ ID NO: 1330 - RNA, 25 nt, Artificial Sequence
  Synthetic oligonucleotide
ugggauuucauguaaccaagaguau

SEQ ID NO: 1331 - RNA, 25 nt, Artificial Sequence
  Synthetic oligonucleotide
gggauuucauguaaccaagaguauu

SEQ ID NO: 1332 - RNA, 25 nt, Artificial Sequence
  Synthetic oligonucleotide
ggauuucauguaaccaagaguauuc

SEQ ID NO: 1333 - RNA, 25 nt, Artificial Sequence
  Synthetic oligonucleotide
gauuucauguaaccaagaguauucc

SEQ ID NO: 1334 - RNA, 25 nt, Artificial Sequence
  Synthetic oligonucleotide
auuucauguaaccaagaguauucca

SEQ ID NO: 1335 - RNA, 25 nt, Artificial Sequence
  Synthetic oligonucleotide
uuucauguaaccaagaguauuccau

SEQ ID NO: 1336 - RNA, 25 nt, Artificial Sequence
  Synthetic oligonucleotide
uucauguaaccaagaguauuccauu

SEQ ID NO: 1337 - RNA, 25 nt, Artificial Sequence
  Synthetic oligonucleotide
ucauguaaccaagaguauuccauuu

SEQ ID NO: 1338 - RNA, 25 nt, Artificial Sequence
  Synthetic oligonucleotide
cauguaaccaagaguauuccauuuu

SEQ ID NO: 1339 - RNA, 25 nt, Artificial Sequence
  Synthetic oligonucleotide
auguaaccaagaguauuccauuuuu

SEQ ID NO: 1340 - RNA, 25 nt, Artificial Sequence
  Synthetic oligonucleotide
uguaaccaagaguauuccauuuuua

SEQ ID NO: 1341 - RNA, 25 nt, Artificial Sequence
  Synthetic oligonucleotide
guaaccaagaguauuccauuuuuac

SEQ ID NO: 1342 - RNA, 25 nt, Artificial Sequence
  Synthetic oligonucleotide
uaaccaagaguauuccauuuuuacu

SEQ ID NO: 1343 - RNA, 25 nt, Artificial Sequence
  Synthetic oligonucleotide
aaccaagaguauuccauuuuuacua

SEQ ID NO: 1344 - RNA, 25 nt, Artificial Sequence
  Synthetic oligonucleotide
accaagaguauuccauuuuuacuaa

SEQ ID NO: 1345 - RNA, 25 nt, Artificial Sequence
  Synthetic oligonucleotide
ccaagaguauuccauuuuuacuaaa

SEQ ID NO: 1346 - RNA, 25 nt, Artificial Sequence
  Synthetic oligonucleotide
caagaguauuccauuuuuacuaaag

SEQ ID NO: 1347 - RNA, 25 nt, Artificial Sequence
  Synthetic oligonucleotide
aagaguauuccauuuuuacuaaagc

SEQ ID NO: 1348 - RNA, 25 nt, Artificial Sequence
  Synthetic oligonucleotide
agaguauuccauuuuuacuaaagca

SEQ ID NO: 1349 - RNA, 25 nt, Artificial Sequence
  Synthetic oligonucleotide
gaguauuccauuuuuacuaaagcag

SEQ ID NO: 1350 - RNA, 25 nt, Artificial Sequence
  Synthetic oligonucleotide
aguauuccauuuuuacuaaagcagu

SEQ ID NO: 1351 - RNA, 25 nt, Artificial Sequence
  Synthetic oligonucleotide
guauuccauuuuuacuaaagcagug

SEQ ID NO: 1352 - RNA, 25 nt, Artificial Sequence
  Synthetic oligonucleotide
uauuccauuuuuacuaaagcagugu

SEQ ID NO: 1353 - RNA, 25 nt, Artificial Sequence
  Synthetic oligonucleotide
auuccauuuuuacuaaagcaguguu

SEQ ID NO: 1354 - RNA, 25 nt, Artificial Sequence
  Synthetic oligonucleotide
uuccauuuuuacuaaagcaguguuu

SEQ ID NO: 1355 - RNA, 25 nt, Artificial Sequence
  Synthetic oligonucleotide
uccauuuuuacuaaagcaguguuuu

SEQ ID NO: 1356 - RNA, 25 nt, Artificial Sequence
  Synthetic oligonucleotide
ccauuuuuacuaaagcaguguuuuc

SEQ ID NO: 1357 - RNA, 25 nt, Artificial Sequence
  Synthetic oligonucleotide
cauuuuuacuaaagcaguguuuuca

SEQ ID NO: 1358 - RNA, 25 nt, Artificial Sequence
  Synthetic oligonucleotide
auuuuuacuaaagcaguguuuucac

SEQ ID NO: 1359 - RNA, 25 nt, Artificial Sequence
  Synthetic oligonucleotide
uuuuuacuaaagcaguguuuucacc

SEQ ID NO: 1360 - RNA, 25 nt, Artificial Sequence
  Synthetic oligonucleotide
uuuuacuaaagcaguguuuucaccu

SEQ ID NO: 1361 - RNA, 25 nt, Artificial Sequence
  Synthetic oligonucleotide
uuuacuaaagcaguguuuucaccuc

SEQ ID NO: 1362 - RNA, 25 nt, Artificial Sequence
  Synthetic oligonucleotide
uuacuaaagcaguguuuucaccuca

SEQ ID NO: 1363 - RNA, 25 nt, Artificial Sequence
  Synthetic oligonucleotide
uacuaaagcaguguuuucaccucau

SEQ ID NO: 1364 - RNA, 25 nt, Artificial Sequence
  Synthetic oligonucleotide
acuaaagcaguguuuucaccucaua

SEQ ID NO: 1365 - RNA, 25 nt, Artificial Sequence
  Synthetic oligonucleotide
cuaaagcaguguuuucaccucauau

SEQ ID NO: 1366 - RNA, 25 nt, Artificial Sequence
  Synthetic oligonucleotide
uaaagcaguguuuucaccucauaug

SEQ ID NO: 1367 - RNA, 25 nt, Artificial Sequence
  Synthetic oligonucleotide
aaagcaguguuuucaccucauaugc

SEQ ID NO: 1368 - RNA, 25 nt, Artificial Sequence
  Synthetic oligonucleotide
aagcaguguuuucaccucauaugcu

SEQ ID NO: 1369 - RNA, 25 nt, Artificial Sequence
  Synthetic oligonucleotide
agcaguguuuucaccucauaugcua

SEQ ID NO: 1370 - RNA, 25 nt, Artificial Sequence
  Synthetic oligonucleotide
gcaguguuuucaccucauaugcuau

SEQ ID NO: 1371 - RNA, 25 nt, Artificial Sequence
  Synthetic oligonucleotide
caguguuuucaccucauaugcuaug

SEQ ID NO: 1372 - RNA, 25 nt, Artificial Sequence
  Synthetic oligonucleotide
aguguuuucaccucauaugcuaugu

SEQ ID NO: 1373 - RNA, 25 nt, Artificial Sequence
  Synthetic oligonucleotide
guguuuucaccucauaugcuauguu

SEQ ID NO: 1374 - RNA, 25 nt, Artificial Sequence
  Synthetic oligonucleotide
uguuuucaccucauaugcuauguua

SEQ ID NO: 1375 - RNA, 25 nt, Artificial Sequence
  Synthetic oligonucleotide
guuuucaccucauaugcuauguuag

SEQ ID NO: 1376 - RNA, 25 nt, Artificial Sequence
  Synthetic oligonucleotide
uuuucaccucauaugcuauguuaga

SEQ ID NO: 1377 - RNA, 25 nt, Artificial Sequence
  Synthetic oligonucleotide
uuucaccucauaugcuauguuagaa

SEQ ID NO: 1378 - RNA, 25 nt, Artificial Sequence
  Synthetic oligonucleotide
uucaccucauaugcuauguuagaag

SEQ ID NO: 1379 - RNA, 25 nt, Artificial Sequence
  Synthetic oligonucleotide
ucaccucauaugcuauguuagaagu

SEQ ID NO: 1380 - RNA, 25 nt, Artificial Sequence
  Synthetic oligonucleotide
caccucauaugcuauguuagaaguc

SEQ ID NO: 1381 - RNA, 25 nt, Artificial Sequence
  Synthetic oligonucleotide
accucauaugcuauguuagaagucc

SEQ ID NO: 1382 - RNA, 25 nt, Artificial Sequence
  Synthetic oligonucleotide
ccucauaugcuauguuagaagucca

SEQ ID NO: 1383 - RNA, 25 nt, Artificial Sequence
  Synthetic oligonucleotide
cucauaugcuauguuagaaguccag

SEQ ID NO: 1384 - RNA, 25 nt, Artificial Sequence
  Synthetic oligonucleotide
ucauaugcuauguuagaaguccagg

SEQ ID NO: 1385 - RNA, 25 nt, Artificial Sequence
  Synthetic oligonucleotide
cauaugcuauguuagaaguccaggc

SEQ ID NO: 1386 - RNA, 25 nt, Artificial Sequence
  Synthetic oligonucleotide
auaugcuauguuagaaguccaggca

SEQ ID NO: 1387 - RNA, 25 nt, Artificial Sequence
  Synthetic oligonucleotide
uaugcuauguuagaaguccaggcag

SEQ ID NO: 1388 - RNA, 25 nt, Artificial Sequence
  Synthetic oligonucleotide
augcuauguuagaaguccaggcaga

SEQ ID NO: 1389 - RNA, 25 nt, Artificial Sequence
  Synthetic oligonucleotide
cuauguuagaaguccaggcagagac

SEQ ID NO: 1390 - RNA, 25 nt, Artificial Sequence
  Synthetic oligonucleotide
auguuagaaguccaggcagagacaa

SEQ ID NO: 1391 - RNA, 25 nt, Artificial Sequence
  Synthetic oligonucleotide
uguuagaaguccaggcagagacaau

SEQ ID NO: 1392 - RNA, 25 nt, Artificial Sequence
  Synthetic oligonucleotide
guuagaaguccaggcagagacaaua

SEQ ID NO: 1393 - RNA, 25 nt, Artificial Sequence
  Synthetic oligonucleotide
uuagaaguccaggcagagacaauaa

SEQ ID NO: 1394 - RNA, 25 nt, Artificial Sequence
  Synthetic oligonucleotide
uagaaguccaggcagagacaauaaa

SEQ ID NO: 1395 - RNA, 25 nt, Artificial Sequence
  Synthetic oligonucleotide
agaaguccaggcagagacaauaaaa

SEQ ID NO: 1396 - RNA, 25 nt, Artificial Sequence
  Synthetic oligonucleotide
gaaguccaggcagagacaauaaaac

SEQ ID NO: 1397 - RNA, 25 nt, Artificial Sequence
  Synthetic oligonucleotide
aaguccaggcagagacaauaaaaca

SEQ ID NO: 1398 - RNA, 25 nt, Artificial Sequence
  Synthetic oligonucleotide
aguccaggcagagacaauaaaacau

SEQ ID NO: 1399 - RNA, 25 nt, Artificial Sequence
  Synthetic oligonucleotide
guccaggcagagacaauaaaacauu

SEQ ID NO: 1400 - RNA, 25 nt, Artificial Sequence
  Synthetic oligonucleotide
uccaggcagagacaauaaaacauuc

SEQ ID NO: 1401 - RNA, 25 nt, Artificial Sequence
  Synthetic oligonucleotide
caggcagagacaauaaaacauuccu

SEQ ID NO: 1402 - RNA, 25 nt, Artificial Sequence
  Synthetic oligonucleotide
aggcagagacaauaaaacauuccug

SEQ ID NO: 1403 - RNA, 25 nt, Artificial Sequence
  Synthetic oligonucleotide
ggcagagacaauaaaacauuccugu

SEQ ID NO: 1404 - RNA, 25 nt, Artificial Sequence
  Synthetic oligonucleotide
gcagagacaauaaaacauuccugug

SEQ ID NO: 1405 - RNA, 25 nt, Artificial Sequence
  Synthetic oligonucleotide
cagagacaauaaaacauuccuguga

SEQ ID NO: 1406 - RNA, 25 nt, Artificial Sequence
  Synthetic oligonucleotide
agagacaauaaaacauuccugugaa

SEQ ID NO: 1407 - RNA, 25 nt, Artificial Sequence
  Synthetic oligonucleotide
gagacaauaaaacauuccugugaaa

SEQ ID NO: 1408 - RNA, 25 nt, Artificial Sequence
  Synthetic oligonucleotide
agacaauaaaacauuccugugaaag

SEQ ID NO: 1409 - RNA, 25 nt, Artificial Sequence
  Synthetic oligonucleotide
gacaauaaaacauuccugugaaagg

SEQ ID NO: 1410 - RNA, 25 nt, Artificial Sequence
  Synthetic oligonucleotide
acaauaaaacauuccugugaaaggc

SEQ ID NO: 1411 - RNA, 25 nt, Artificial Sequence
  Synthetic oligonucleotide
caauaaaacauuccugugaaaggca

SEQ ID NO: 1412 - RNA, 25 nt, Artificial Sequence
  Synthetic oligonucleotide
aauaaaacauuccugugaaaggcac

SEQ ID NO: 1413 - RNA, 25 nt, Artificial Sequence
  Synthetic oligonucleotide
auaaaacauuccugugaaaggcacu

SEQ ID NO: 1414 - RNA, 25 nt, Artificial Sequence
  Synthetic oligonucleotide
aaacauuccugugaaaggcacuuuu

SEQ ID NO: 1415 - RNA, 25 nt, Artificial Sequence
  Synthetic oligonucleotide
aacauuccugugaaaggcacuuuuc

SEQ ID NO: 1416 - RNA, 25 nt, Artificial Sequence
  Synthetic oligonucleotide
acauuccugugaaaggcacuuuuca

SEQ ID NO: 1417 - RNA, 25 nt, Artificial Sequence
  Synthetic oligonucleotide
cauuccugugaaaggcacuuuucau

SEQ ID NO: 1418 - RNA, 25 nt, Artificial Sequence
  Synthetic oligonucleotide
auuccugugaaaggcacuuuucauu

SEQ ID NO: 1419 - RNA, 25 nt, Artificial Sequence
  Synthetic oligonucleotide
uuccugugaaaggcacuuuucauuc

SEQ ID NO: 1420 - RNA, 25 nt, Artificial Sequence
  Synthetic oligonucleotide
ccugugaaaggcacuuuucauucca

SEQ ID NO: 1421 - RNA, 25 nt, Artificial Sequence
  Synthetic oligonucleotide
cugugaaaggcacuuuucauuccac

SEQ ID NO: 1422 - RNA, 25 nt, Artificial Sequence
  Synthetic oligonucleotide
ugugaaaggcacuuuucauuccacu

SEQ ID NO: 1423 - RNA, 25 nt, Artificial Sequence
  Synthetic oligonucleotide
gugaaaggcacuuuucauuccacuu

SEQ ID NO: 1424 - RNA, 25 nt, Artificial Sequence
  Synthetic oligonucleotide
ugaaaggcacuuuucauuccacuuu

SEQ ID NO: 1425 - RNA, 25 nt, Artificial Sequence
  Synthetic oligonucleotide
gaaaggcacuuuucauuccacuuua

SEQ ID NO: 1426 - RNA, 25 nt, Artificial Sequence
  Synthetic oligonucleotide
aaaggcacuuuucauuccacuuuaa

SEQ ID NO: 1427 - RNA, 25 nt, Artificial Sequence
  Synthetic oligonucleotide
aaggcacuuuucauuccacuuuaac

SEQ ID NO: 1428 - RNA, 25 nt, Artificial Sequence
  Synthetic oligonucleotide
aggcacuuuucauuccacuuuaacu

SEQ ID NO: 1429 - RNA, 25 nt, Artificial Sequence
  Synthetic oligonucleotide
ggcacuuuucauuccacuuuaacuu

SEQ ID NO: 1430 - RNA, 25 nt, Artificial Sequence
  Synthetic oligonucleotide
gcacuuuucauuccacuuuaacuug

SEQ ID NO: 1431 - RNA, 25 nt, Artificial Sequence
  Synthetic oligonucleotide
cacuuuucauuccacuuuaacuuga

SEQ ID NO: 1432 - RNA, 25 nt, Artificial Sequence
  Synthetic oligonucleotide
acuuuucauuccacuuuaacuugau

SEQ ID NO: 1433 - RNA, 25 nt, Artificial Sequence
  Synthetic oligonucleotide
cuuuucauuccacuuuaacuugauu

SEQ ID NO: 1434 - RNA, 25 nt, Artificial Sequence
  Synthetic oligonucleotide
uuuucauuccacuuuaacuugauuu

SEQ ID NO: 1435 - RNA, 25 nt, Artificial Sequence
  Synthetic oligonucleotide
uuucauuccacuuuaacuugauuuu

SEQ ID NO: 1436 - RNA, 25 nt, Artificial Sequence
  Synthetic oligonucleotide
uucauuccacuuuaacuugauuuuu

SEQ ID NO: 1437 - RNA, 25 nt, Artificial Sequence
  Synthetic oligonucleotide
ucauuccacuuuaacuugauuuuuu

SEQ ID NO: 1438 - RNA, 25 nt, Artificial Sequence
  Synthetic oligonucleotide
cauuccacuuuaacuugauuuuuua

SEQ ID NO: 1439 - RNA, 25 nt, Artificial Sequence
  Synthetic oligonucleotide
auuccacuuuaacuugauuuuuuaa

SEQ ID NO: 1440 - RNA, 25 nt, Artificial Sequence
  Synthetic oligonucleotide
uuccacuuuaacuugauuuuuuaaa

SEQ ID NO: 1441 - RNA, 25 nt, Artificial Sequence
  Synthetic oligonucleotide
uccacuuuaacuugauuuuuuaaau

SEQ ID NO: 1442 - RNA, 25 nt, Artificial Sequence
  Synthetic oligonucleotide
ccacuuuaacuugauuuuuuaaauu

SEQ ID NO: 1443 - RNA, 25 nt, Artificial Sequence
  Synthetic oligonucleotide
cacuuuaacuugauuuuuuaaauuc

SEQ ID NO: 1444 - RNA, 25 nt, Artificial Sequence
  Synthetic oligonucleotide
acuuuaacuugauuuuuuaaauucc

SEQ ID NO: 1445 - RNA, 25 nt, Artificial Sequence
  Synthetic oligonucleotide
cuuuaacuugauuuuuuaaauuccc

SEQ ID NO: 1446 - RNA, 25 nt, Artificial Sequence
  Synthetic oligonucleotide
uuuaacuugauuuuuuaaauucccu

SEQ ID NO: 1447 - RNA, 25 nt, Artificial Sequence
  Synthetic oligonucleotide
uuaacuugauuuuuuaaauucccuu

SEQ ID NO: 1448 - RNA, 25 nt, Artificial Sequence
  Synthetic oligonucleotide
uaacuugauuuuuuaaauucccuua

SEQ ID NO: 1449 - RNA, 25 nt, Artificial Sequence
  Synthetic oligonucleotide
aacuugauuuuuuaaauucccuuau

SEQ ID NO: 1450 - RNA, 25 nt, Artificial Sequence
  Synthetic oligonucleotide
acuugauuuuuuaaauucccuuauu

SEQ ID NO: 1451 - RNA, 25 nt, Artificial Sequence
  Synthetic oligonucleotide
cuugauuuuuuaaauucccuuauug

SEQ ID NO: 1452 - RNA, 25 nt, Artificial Sequence
  Synthetic oligonucleotide
uugauuuuuuaaauucccuuauugu

SEQ ID NO: 1453 - RNA, 25 nt, Artificial Sequence
  Synthetic oligonucleotide
ugauuuuuuaaauucccuuauuguc

SEQ ID NO: 1454 - RNA, 25 nt, Artificial Sequence
  Synthetic oligonucleotide
gauuuuuuaaauucccuuauugucc

SEQ ID NO: 1455 - RNA, 25 nt, Artificial Sequence
  Synthetic oligonucleotide
auuuuuuaaauucccuuauuguccc

SEQ ID NO: 1456 - RNA, 25 nt, Artificial Sequence
  Synthetic oligonucleotide
uuuuuaaauucccuuauugucccuu

SEQ ID NO: 1457 - RNA, 25 nt, Artificial Sequence
  Synthetic oligonucleotide
aaauucccuuauugucccuuccaaa

SEQ ID NO: 1458 - RNA, 25 nt, Artificial Sequence
  Synthetic oligonucleotide
aauucccuuauugucccuuccaaaa

SEQ ID NO: 1459 - RNA, 25 nt, Artificial Sequence
  Synthetic oligonucleotide
ucccuuauugucccuuccaaaaaaa

SEQ ID NO: 1460 - RNA, 25 nt, Artificial Sequence
  Synthetic oligonucleotide
aaaaagagaaucaaaauuuuacaaa

SEQ ID NO: 1461 - RNA, 25 nt, Artificial Sequence
  Synthetic oligonucleotide
aaaagagaaucaaaauuuuacaaag

SEQ ID NO: 1462 - RNA, 25 nt, Artificial Sequence
  Synthetic oligonucleotide
aaagagaaucaaaauuuuacaaaga

SEQ ID NO: 1463 - RNA, 25 nt, Artificial Sequence
  Synthetic oligonucleotide
aagagaaucaaaauuuuacaaagaa

SEQ ID NO: 1464 - RNA, 25 nt, Artificial Sequence
  Synthetic oligonucleotide
agagaaucaaaauuuuacaaagaau

SEQ ID NO: 1465 - RNA, 25 nt, Artificial Sequence
  Synthetic oligonucleotide
gagaaucaaaauuuuacaaagaauc

SEQ ID NO: 1466 - RNA, 25 nt, Artificial Sequence
  Synthetic oligonucleotide
agaaucaaaauuuuacaaagaauca

SEQ ID NO: 1467 - RNA, 25 nt, Artificial Sequence
  Synthetic oligonucleotide
gaaucaaaauuuuacaaagaaucaa

SEQ ID NO: 1468 - RNA, 25 nt, Artificial Sequence
  Synthetic oligonucleotide
aaucaaaauuuuacaaagaaucaaa

SEQ ID NO: 1469 - RNA, 25 nt, Artificial Sequence
  Synthetic oligonucleotide
aucaaaauuuuacaaagaaucaaag

SEQ ID NO: 1470 - RNA, 25 nt, Artificial Sequence
  Synthetic oligonucleotide
ucaaaauuuuacaaagaaucaaagg

SEQ ID NO: 1471 - RNA, 25 nt, Artificial Sequence
  Synthetic oligonucleotide
caaaauuuuacaaagaaucaaagga

SEQ ID NO: 1472 - RNA, 25 nt, Artificial Sequence
  Synthetic oligonucleotide
aaaauuuuacaaagaaucaaaggaa

SEQ ID NO: 1473 - RNA, 25 nt, Artificial Sequence
  Synthetic oligonucleotide
aaauuuuacaaagaaucaaaggaau

SEQ ID NO: 1474 - RNA, 25 nt, Artificial Sequence
  Synthetic oligonucleotide
aauuuuacaaagaaucaaaggaauu

SEQ ID NO: 1475 - RNA, 25 nt, Artificial Sequence
  Synthetic oligonucleotide
uuuuacaaagaaucaaaggaauucu

SEQ ID NO: 1476 - RNA, 25 nt, Artificial Sequence
  Synthetic oligonucleotide
uuuacaaagaaucaaaggaauucua

SEQ ID NO: 1477 - RNA, 25 nt, Artificial Sequence
  Synthetic oligonucleotide
uuacaaagaaucaaaggaauucuag

SEQ ID NO: 1478 - RNA, 25 nt, Artificial Sequence
  Synthetic oligonucleotide
uacaaagaaucaaaggaauucuaga

SEQ ID NO: 1479 - RNA, 25 nt, Artificial Sequence
  Synthetic oligonucleotide
acaaagaaucaaaggaauucuagaa

SEQ ID NO: 1480 - RNA, 25 nt, Artificial Sequence
  Synthetic oligonucleotide
caaagaaucaaaggaauucuagaaa

SEQ ID NO: 1481 - RNA, 25 nt, Artificial Sequence
  Synthetic oligonucleotide
aaagaaucaaaggaauucuagaaag

SEQ ID NO: 1482 - RNA, 25 nt, Artificial Sequence
  Synthetic oligonucleotide
aagaaucaaaggaauucuagaaagu

SEQ ID NO: 1483 - RNA, 25 nt, Artificial Sequence
  Synthetic oligonucleotide
agaaucaaaggaauucuagaaagua

SEQ ID NO: 1484 - RNA, 25 nt, Artificial Sequence
  Synthetic oligonucleotide
gaaucaaaggaauucuagaaaguau

SEQ ID NO: 1485 - RNA, 25 nt, Artificial Sequence
  Synthetic oligonucleotide
aaucaaaggaauucuagaaaguauc

SEQ ID NO: 1486 - RNA, 25 nt, Artificial Sequence
  Synthetic oligonucleotide
aucaaaggaauucuagaaaguaucu

SEQ ID NO: 1487 - RNA, 25 nt, Artificial Sequence
  Synthetic oligonucleotide
ucaaaggaauucuagaaaguaucug

SEQ ID NO: 1488 - RNA, 25 nt, Artificial Sequence
  Synthetic oligonucleotide
caaaggaauucuagaaaguaucugg

SEQ ID NO: 1489 - RNA, 25 nt, Artificial Sequence
  Synthetic oligonucleotide
aaaggaauucuagaaaguaucuggg

SEQ ID NO: 1490 - RNA, 25 nt, Artificial Sequence
  Synthetic oligonucleotide
aggagagauccaaauuuccauuguc

SEQ ID NO: 1491 - RNA, 25 nt, Artificial Sequence
  Synthetic oligonucleotide
ggagagauccaaauuuccauugucu

SEQ ID NO: 1492 - RNA, 25 nt, Artificial Sequence
  Synthetic oligonucleotide
gagauccaaauuuccauugucuugc

SEQ ID NO: 1493 - RNA, 25 nt, Artificial Sequence
  Synthetic oligonucleotide
agauccaaauuuccauugucuugca

SEQ ID NO: 1494 - RNA, 25 nt, Artificial Sequence
  Synthetic oligonucleotide
gauccaaauuuccauugucuugcaa

SEQ ID NO: 1495 - RNA, 25 nt, Artificial Sequence
  Synthetic oligonucleotide
auccaaauuuccauugucuugcaag

SEQ ID NO: 1496 - RNA, 25 nt, Artificial Sequence
  Synthetic oligonucleotide
uccaaauuuccauugucuugcaagc

SEQ ID NO: 1497 - RNA, 25 nt, Artificial Sequence
  Synthetic oligonucleotide
ccaaauuuccauugucuugcaagca

SEQ ID NO: 1498 - RNA, 25 nt, Artificial Sequence
  Synthetic oligonucleotide
caaauuuccauugucuugcaagcaa

SEQ ID NO: 1499 - RNA, 25 nt, Artificial Sequence
  Synthetic oligonucleotide
aaauuuccauugucuugcaagcaaa

SEQ ID NO: 1500 - RNA, 25 nt, Artificial Sequence
  Synthetic oligonucleotide
aauuuccauugucuugcaagcaaag

SEQ ID NO: 1501 - RNA, 25 nt, Artificial Sequence
  Synthetic oligonucleotide
auuuccauugucuugcaagcaaagc

SEQ ID NO: 1502 - RNA, 25 nt, Artificial Sequence
  Synthetic oligonucleotide
uuuccauugucuugcaagcaaagca

SEQ ID NO: 1503 - RNA, 25 nt, Artificial Sequence
  Synthetic oligonucleotide
uuccauugucuugcaagcaaagcac

SEQ ID NO: 1504 - RNA, 25 nt, Artificial Sequence
  Synthetic oligonucleotide
uccauugucuugcaagcaaagcacg

SEQ ID NO: 1505 - RNA, 25 nt, Artificial Sequence
  Synthetic oligonucleotide
ccauugucuugcaagcaaagcacgu

SEQ ID NO: 1506 - RNA, 25 nt, Artificial Sequence
  Synthetic oligonucleotide
cauugucuugcaagcaaagcacgua

SEQ ID NO: 1507 - RNA, 25 nt, Artificial Sequence
  Synthetic oligonucleotide
auugucuugcaagcaaagcacguau

SEQ ID NO: 1508 - RNA, 25 nt, Artificial Sequence
  Synthetic oligonucleotide
uugucuugcaagcaaagcacguauu

SEQ ID NO: 1509 - RNA, 25 nt, Artificial Sequence
  Synthetic oligonucleotide
ugucuugcaagcaaagcacguauua

SEQ ID NO: 1510 - RNA, 25 nt, Artificial Sequence
  Synthetic oligonucleotide
gucuugcaagcaaagcacguauuaa

SEQ ID NO: 1511 - RNA, 25 nt, Artificial Sequence
  Synthetic oligonucleotide
ucuugcaagcaaagcacguauuaaa

SEQ ID NO: 1512 - RNA, 25 nt, Artificial Sequence
  Synthetic oligonucleotide
cuugcaagcaaagcacguauuaaau

SEQ ID NO: 1513 - RNA, 25 nt, Artificial Sequence
  Synthetic oligonucleotide
uugcaagcaaagcacguauuaaaua

SEQ ID NO: 1514 - RNA, 25 nt, Artificial Sequence
  Synthetic oligonucleotide
ugcaagcaaagcacguauuaaauau

SEQ ID NO: 1515 - RNA, 25 nt, Artificial Sequence
  Synthetic oligonucleotide
gcaagcaaagcacguauuaaauaug

SEQ ID NO: 1516 - RNA, 25 nt, Artificial Sequence
  Synthetic oligonucleotide
caagcaaagcacguauuaaauauga

SEQ ID NO: 1517 - RNA, 25 nt, Artificial Sequence
  Synthetic oligonucleotide
aagcaaagcacguauuaaauaugau

SEQ ID NO: 1518 - RNA, 25 nt, Artificial Sequence
  Synthetic oligonucleotide
agcaaagcacguauuaaauaugauc

SEQ ID NO: 1519 - RNA, 25 nt, Artificial Sequence
  Synthetic oligonucleotide
gcaaagcacguauuaaauaugaucu

SEQ ID NO: 1520 - RNA, 25 nt, Artificial Sequence
  Synthetic oligonucleotide
caaagcacguauuaaauaugaucug

SEQ ID NO: 1521 - RNA, 25 nt, Artificial Sequence
  Synthetic oligonucleotide
aaagcacguauuaaauaugaucugc

SEQ ID NO: 1522 - RNA, 25 nt, Artificial Sequence
  Synthetic oligonucleotide
aagcacguauuaaauaugaucugca

SEQ ID NO: 1523 - RNA, 25 nt, Artificial Sequence
  Synthetic oligonucleotide
agcacguauuaaauaugaucugcag

SEQ ID NO: 1524 - RNA, 25 nt, Artificial Sequence
  Synthetic oligonucleotide
gcacguauuaaauaugaucugcagc

SEQ ID NO: 1525 - RNA, 25 nt, Artificial Sequence
  Synthetic oligonucleotide
cacguauuaaauaugaucugcagcc

SEQ ID NO: 1526 - RNA, 25 nt, Artificial Sequence
  Synthetic oligonucleotide
cguauuaaauaugaucugcagccau

SEQ ID NO: 1527 - RNA, 25 nt, Artificial Sequence
  Synthetic oligonucleotide
guauuaaauaugaucugcagccauu

SEQ ID NO: 1528 - RNA, 25 nt, Artificial Sequence
  Synthetic oligonucleotide
auuaaauaugaucugcagccauuaa

SEQ ID NO: 1529 - RNA, 25 nt, Artificial Sequence
  Synthetic oligonucleotide
uuaaauaugaucugcagccauuaaa

SEQ ID NO: 1530 - RNA, 25 nt, Artificial Sequence
  Synthetic oligonucleotide
uaaauaugaucugcagccauuaaaa

SEQ ID NO: 1531 - RNA, 25 nt, Artificial Sequence
  Synthetic oligonucleotide
aaauaugaucugcagccauuaaaaa

SEQ ID NO: 1532 - RNA, 25 nt, Artificial Sequence
  Synthetic oligonucleotide
aauaugaucugcagccauuaaaaag

SEQ ID NO: 1533 - RNA, 25 nt, Artificial Sequence
  Synthetic oligonucleotide
auaugaucugcagccauuaaaaaga

SEQ ID NO: 1534 - RNA, 25 nt, Artificial Sequence
  Synthetic oligonucleotide
uaugaucugcagccauuaaaaagac

SEQ ID NO: 1535 - RNA, 25 nt, Artificial Sequence
  Synthetic oligonucleotide
augaucugcagccauuaaaaagaca

SEQ ID NO: 1536 - RNA, 25 nt, Artificial Sequence
  Synthetic oligonucleotide
ugaucugcagccauuaaaaagacac

SEQ ID NO: 1537 - RNA, 21 nt, Artificial Sequence
  Synthetic oligonucleotide
guugacuaagucaauaaucag

SEQ ID NO: 1538 - RNA, 21 nt, Artificial Sequence
  Synthetic oligonucleotide
uugacuaagucaauaaucaga

SEQ ID NO: 1539 - RNA, 21 nt, Artificial Sequence
  Synthetic oligonucleotide
ugacuaagucaauaaucagaa

SEQ ID NO: 1540 - RNA, 21 nt, Artificial Sequence
  Synthetic oligonucleotide
gacuaagucaauaaucagaau

SEQ ID NO: 1541 - RNA, 21 nt, Artificial Sequence
  Synthetic oligonucleotide
acuaagucaauaaucagaauc

SEQ ID NO: 1542 - RNA, 21 nt, Artificial Sequence
  Synthetic oligonucleotide
cuaagucaauaaucagaauca

SEQ ID NO: 1543 - RNA, 21 nt, Artificial Sequence
  Synthetic oligonucleotide
uaagucaauaaucagaaucag

SEQ ID NO: 1544 - RNA, 21 nt, Artificial Sequence
  Synthetic oligonucleotide
aagucaauaaucagaaucagc

SEQ ID NO: 1545 - RNA, 21 nt, Artificial Sequence
  Synthetic oligonucleotide
agucaauaaucagaaucagca

SEQ ID NO: 1546 - RNA, 21 nt, Artificial Sequence
  Synthetic oligonucleotide
gucaauaaucagaaucagcag

SEQ ID NO: 1547 - RNA, 21 nt, Artificial Sequence
  Synthetic oligonucleotide
ucaauaaucagaaucagcagg

SEQ ID NO: 1548 - RNA, 21 nt, Artificial Sequence
  Synthetic oligonucleotide
caauaaucagaaucagcaggu

SEQ ID NO: 1549 - RNA, 21 nt, Artificial Sequence
  Synthetic oligonucleotide
aauaaucagaaucagcagguu

SEQ ID NO: 1550 - RNA, 21 nt, Artificial Sequence
  Synthetic oligonucleotide
auaaucagaaucagcagguuu

SEQ ID NO: 1551 - RNA, 21 nt, Artificial Sequence
  Synthetic oligonucleotide
uaaucagaaucagcagguuug

SEQ ID NO: 1552 - RNA, 21 nt, Artificial Sequence
  Synthetic oligonucleotide
aucagaaucagcagguuugca

SEQ ID NO: 1553 - RNA, 21 nt, Artificial Sequence
  Synthetic oligonucleotide
ucagaaucagcagguuugcag

SEQ ID NO: 1554 - RNA, 21 nt, Artificial Sequence
  Synthetic oligonucleotide
agaaucagcagguuugcaguc

SEQ ID NO: 1555 - RNA, 21 nt, Artificial Sequence
  Synthetic oligonucleotide
gaaucagcagguuugcaguca

SEQ ID NO: 1556 - RNA, 21 nt, Artificial Sequence
  Synthetic oligonucleotide
uugcagucagauuggcaggga

SEQ ID NO: 1557 - RNA, 21 nt, Artificial Sequence
  Synthetic oligonucleotide
cagccuagcucaggagaagug

SEQ ID NO: 1558 - RNA, 21 nt, Artificial Sequence
  Synthetic oligonucleotide
ccuagcucaggagaagugagu

SEQ ID NO: 1559 - RNA, 21 nt, Artificial Sequence
  Synthetic oligonucleotide
cuagcucaggagaagugagua

SEQ ID NO: 1560 - RNA, 21 nt, Artificial Sequence
  Synthetic oligonucleotide
uagcucaggagaagugaguau

SEQ ID NO: 1561 - RNA, 21 nt, Artificial Sequence
  Synthetic oligonucleotide
agcucaggagaagugaguaua

SEQ ID NO: 1562 - RNA, 21 nt, Artificial Sequence
  Synthetic oligonucleotide
cucaggagaagugaguauaaa

SEQ ID NO: 1563 - RNA, 21 nt, Artificial Sequence
  Synthetic oligonucleotide
gagcagccaucacagaagucc

SEQ ID NO: 1564 - RNA, 21 nt, Artificial Sequence
  Synthetic oligonucleotide
agcagccaucacagaagucca

SEQ ID NO: 1565 - RNA, 21 nt, Artificial Sequence
  Synthetic oligonucleotide
gcagccaucacagaaguccac

SEQ ID NO: 1566 - RNA, 21 nt, Artificial Sequence
  Synthetic oligonucleotide
cagccaucacagaaguccacu

SEQ ID NO: 1567 - RNA, 21 nt, Artificial Sequence
  Synthetic oligonucleotide
agccaucacagaaguccacuc

SEQ ID NO: 1568 - RNA, 21 nt, Artificial Sequence
  Synthetic oligonucleotide
gccaucacagaaguccacuca

SEQ ID NO: 1569 - RNA, 21 nt, Artificial Sequence
  Synthetic oligonucleotide
ccaucacagaaguccacucau

SEQ ID NO: 1570 - RNA, 21 nt, Artificial Sequence
  Synthetic oligonucleotide
aucacagaaguccacucauuc

SEQ ID NO: 1571 - RNA, 21 nt, Artificial Sequence
  Synthetic oligonucleotide
ucacagaaguccacucauucu

SEQ ID NO: 1572 - RNA, 21 nt, Artificial Sequence
  Synthetic oligonucleotide
cauucuuggcaggauggcuuc

SEQ ID NO: 1573 - RNA, 21 nt, Artificial Sequence
  Synthetic oligonucleotide
auucuuggcaggauggcuucu

SEQ ID NO: 1574 - RNA, 21 nt, Artificial Sequence
  Synthetic oligonucleotide
uucuuggcaggauggcuucuc

SEQ ID NO: 1575 - RNA, 21 nt, Artificial Sequence
  Synthetic oligonucleotide
ucuuggcaggauggcuucuca

SEQ ID NO: 1576 - RNA, 21 nt, Artificial Sequence
  Synthetic oligonucleotide
cuuggcaggauggcuucucau

SEQ ID NO: 1577 - RNA, 21 nt, Artificial Sequence
  Synthetic oligonucleotide
uuggcaggauggcuucucauc

SEQ ID NO: 1578 - RNA, 21 nt, Artificial Sequence
  Synthetic oligonucleotide
uggcaggauggcuucucaucg

SEQ ID NO: 1579 - RNA, 21 nt, Artificial Sequence
  Synthetic oligonucleotide
ggcaggauggcuucucaucgu

SEQ ID NO: 1580 - RNA, 21 nt, Artificial Sequence
  Synthetic oligonucleotide
gcaggauggcuucucaucguc

SEQ ID NO: 1581 - RNA, 21 nt, Artificial Sequence
  Synthetic oligonucleotide
caggauggcuucucaucgucu

SEQ ID NO: 1582 - RNA, 21 nt, Artificial Sequence
  Synthetic oligonucleotide
aggauggcuucucaucgucug

SEQ ID NO: 1583 - RNA, 21 nt, Artificial Sequence
  Synthetic oligonucleotide
ggauggcuucucaucgucugc

SEQ ID NO: 1584 - RNA, 21 nt, Artificial Sequence
  Synthetic oligonucleotide
gauggcuucucaucgucugcu

SEQ ID NO: 1585 - RNA, 21 nt, Artificial Sequence
  Synthetic oligonucleotide
auggcuucucaucgucugcuc

SEQ ID NO: 1586 - RNA, 21 nt, Artificial Sequence
  Synthetic oligonucleotide
uggcuucucaucgucugcucc

SEQ ID NO: 1587 - RNA, 21 nt, Artificial Sequence
  Synthetic oligonucleotide
ggcuucucaucgucugcuccu

SEQ ID NO: 1588 - RNA, 21 nt, Artificial Sequence
  Synthetic oligonucleotide
ccucugccuugcuggacuggu

SEQ ID NO: 1589 - RNA, 21 nt, Artificial Sequence
  Synthetic oligonucleotide
cucugccuugcuggacuggua

SEQ ID NO: 1590 - RNA, 21 nt, Artificial Sequence
  Synthetic oligonucleotide
caccggugaauccaagugucc

SEQ ID NO: 1591 - RNA, 21 nt, Artificial Sequence
  Synthetic oligonucleotide
ggugaauccaaguguccucug

SEQ ID NO: 1592 - RNA, 21 nt, Artificial Sequence
  Synthetic oligonucleotide
gugaauccaaguguccucuga

SEQ ID NO: 1593 - RNA, 21 nt, Artificial Sequence
  Synthetic oligonucleotide
ugaauccaaguguccucugau

SEQ ID NO: 1594 - RNA, 21 nt, Artificial Sequence
  Synthetic oligonucleotide
gaauccaaguguccucugaug

SEQ ID NO: 1595 - RNA, 21 nt, Artificial Sequence
  Synthetic oligonucleotide
aauccaaguguccucugaugg

SEQ ID NO: 1596 - RNA, 21 nt, Artificial Sequence
  Synthetic oligonucleotide
auccaaguguccucugauggu

SEQ ID NO: 1597 - RNA, 21 nt, Artificial Sequence
  Synthetic oligonucleotide
uccaaguguccucugaugguc

SEQ ID NO: 1598 - RNA, 21 nt, Artificial Sequence
  Synthetic oligonucleotide
ccaaguguccucugaugguca

SEQ ID NO: 1599 - RNA, 21 nt, Artificial Sequence
  Synthetic oligonucleotide
caaguguccucugauggucaa

SEQ ID NO: 1600 - RNA, 21 nt, Artificial Sequence
  Synthetic oligonucleotide
aaguguccucugauggucaaa

SEQ ID NO: 1601 - RNA, 21 nt, Artificial Sequence
  Synthetic oligonucleotide
aguguccucugauggucaaag

SEQ ID NO: 1602 - RNA, 21 nt, Artificial Sequence
  Synthetic oligonucleotide
guguccucugauggucaaagu

SEQ ID NO: 1603 - RNA, 21 nt, Artificial Sequence
  Synthetic oligonucleotide
uguccucugauggucaaaguu

SEQ ID NO: 1604 - RNA, 21 nt, Artificial Sequence
  Synthetic oligonucleotide
guccucugauggucaaaguuc

SEQ ID NO: 1605 - RNA, 21 nt, Artificial Sequence
  Synthetic oligonucleotide
uccucugauggucaaaguucu

SEQ ID NO: 1606 - RNA, 21 nt, Artificial Sequence
  Synthetic oligonucleotide
ccucugauggucaaaguucua

SEQ ID NO: 1607 - RNA, 21 nt, Artificial Sequence
  Synthetic oligonucleotide
cucugauggucaaaguucuag

SEQ ID NO: 1608 - RNA, 21 nt, Artificial Sequence
  Synthetic oligonucleotide
ucugauggucaaaguucuaga

SEQ ID NO: 1609 - RNA, 21 nt, Artificial Sequence
  Synthetic oligonucleotide
cugauggucaaaguucuagau

SEQ ID NO: 1610 - RNA, 21 nt, Artificial Sequence
  Synthetic oligonucleotide
ugauggucaaaguucuagaug

SEQ ID NO: 1611 - RNA, 21 nt, Artificial Sequence
  Synthetic oligonucleotide
gauggucaaaguucuagaugc

SEQ ID NO: 1612 - RNA, 21 nt, Artificial Sequence
  Synthetic oligonucleotide
gagccauuugccucugggaaa

SEQ ID NO: 1613 - RNA, 21 nt, Artificial Sequence
  Synthetic oligonucleotide
agccauuugccucugggaaaa

SEQ ID NO: 1614 - RNA, 21 nt, Artificial Sequence
  Synthetic oligonucleotide
gccauuugccucugggaaaac

SEQ ID NO: 1615 - RNA, 21 nt, Artificial Sequence
  Synthetic oligonucleotide
ccauuugccucugggaaaacc

SEQ ID NO: 1616 - RNA, 21 nt, Artificial Sequence
  Synthetic oligonucleotide
cauuugccucugggaaaacca

SEQ ID NO: 1617 - RNA, 21 nt, Artificial Sequence
  Synthetic oligonucleotide
auuugccucugggaaaaccag

SEQ ID NO: 1618 - RNA, 21 nt, Artificial Sequence
  Synthetic oligonucleotide
uuugccucugggaaaaccagu

SEQ ID NO: 1619 - RNA, 21 nt, Artificial Sequence
  Synthetic oligonucleotide
uugccucugggaaaaccagug

SEQ ID NO: 1620 - RNA, 21 nt, Artificial Sequence
  Synthetic oligonucleotide
ugccucugggaaaaccaguga

SEQ ID NO: 1621 - RNA, 21 nt, Artificial Sequence
  Synthetic oligonucleotide
gccucugggaaaaccagugag

SEQ ID NO: 1622 - RNA, 21 nt, Artificial Sequence
  Synthetic oligonucleotide
ccucugggaaaaccagugagu

SEQ ID NO: 1623 - RNA, 21 nt, Artificial Sequence
  Synthetic oligonucleotide
cucugggaaaaccagugaguc

SEQ ID NO: 1624 - RNA, 21 nt, Artificial Sequence
  Synthetic oligonucleotide
ucugggaaaaccagugagucu

SEQ ID NO: 1625 - RNA, 21 nt, Artificial Sequence
  Synthetic oligonucleotide
cugggaaaaccagugagucug

SEQ ID NO: 1626 - RNA, 21 nt, Artificial Sequence
  Synthetic oligonucleotide
ugggaaaaccagugagucugg

SEQ ID NO: 1627 - RNA, 21 nt, Artificial Sequence
  Synthetic oligonucleotide
gggaaaaccagugagucugga

SEQ ID NO: 1628 - RNA, 21 nt, Artificial Sequence
  Synthetic oligonucleotide
agagcugcaugggcucacaac

SEQ ID NO: 1629 - RNA, 21 nt, Artificial Sequence
  Synthetic oligonucleotide
gagcugcaugggcucacaacu

SEQ ID NO: 1630 - RNA, 21 nt, Artificial Sequence
  Synthetic oligonucleotide
agcugcaugggcucacaacug

SEQ ID NO: 1631 - RNA, 21 nt, Artificial Sequence
  Synthetic oligonucleotide
gcugcaugggcucacaacuga

SEQ ID NO: 1632 - RNA, 21 nt, Artificial Sequence
  Synthetic oligonucleotide
cugcaugggcucacaacugag

SEQ ID NO: 1633 - RNA, 21 nt, Artificial Sequence
  Synthetic oligonucleotide
ugcaugggcucacaacugagg

SEQ ID NO: 1634 - RNA, 21 nt, Artificial Sequence
  Synthetic oligonucleotide
gcaugggcucacaacugagga

SEQ ID NO: 1635 - RNA, 21 nt, Artificial Sequence
  Synthetic oligonucleotide
caugggcucacaacugaggag

SEQ ID NO: 1636 - RNA, 21 nt, Artificial Sequence
  Synthetic oligonucleotide
augggcucacaacugaggagg

SEQ ID NO: 1637 - RNA, 21 nt, Artificial Sequence
  Synthetic oligonucleotide
ugggcucacaacugaggagga

SEQ ID NO: 1638 - RNA, 21 nt, Artificial Sequence
  Synthetic oligonucleotide
gggcucacaacugaggaggaa

SEQ ID NO: 1639 - RNA, 21 nt, Artificial Sequence
  Synthetic oligonucleotide
ggcucacaacugaggaggaau

SEQ ID NO: 1640 - RNA, 21 nt, Artificial Sequence
  Synthetic oligonucleotide
gcucacaacugaggaggaauu

SEQ ID NO: 1641 - RNA, 21 nt, Artificial Sequence
  Synthetic oligonucleotide
cucacaacugaggaggaauuu

SEQ ID NO: 1642 - RNA, 21 nt, Artificial Sequence
  Synthetic oligonucleotide
ucacaacugaggaggaauuug

SEQ ID NO: 1643 - RNA, 21 nt, Artificial Sequence
  Synthetic oligonucleotide
cacaacugaggaggaauuugu

SEQ ID NO: 1644 - RNA, 21 nt, Artificial Sequence
  Synthetic oligonucleotide
caacugaggaggaauuuguag

SEQ ID NO: 1645 - RNA, 21 nt, Artificial Sequence
  Synthetic oligonucleotide
aacugaggaggaauuuguaga

SEQ ID NO: 1646 - RNA, 21 nt, Artificial Sequence
  Synthetic oligonucleotide
acugaggaggaauuuguagaa

SEQ ID NO: 1647 - RNA, 21 nt, Artificial Sequence
  Synthetic oligonucleotide
cugaggaggaauuuguagaag

SEQ ID NO: 1648 - RNA, 21 nt, Artificial Sequence
  Synthetic oligonucleotide
ugaggaggaauuuguagaagg

SEQ ID NO: 1649 - RNA, 21 nt, Artificial Sequence
  Synthetic oligonucleotide
gaggaggaauuuguagaaggg

SEQ ID NO: 1650 - RNA, 21 nt, Artificial Sequence
  Synthetic oligonucleotide
aggaggaauuuguagaaggga

SEQ ID NO: 1651 - RNA, 21 nt, Artificial Sequence
  Synthetic oligonucleotide
ggaggaauuuguagaagggau

SEQ ID NO: 1652 - RNA, 21 nt, Artificial Sequence
  Synthetic oligonucleotide
gaggaauuuguagaagggaua

SEQ ID NO: 1653 - RNA, 21 nt, Artificial Sequence
  Synthetic oligonucleotide
aggaauuuguagaagggauau

SEQ ID NO: 1654 - RNA, 21 nt, Artificial Sequence
  Synthetic oligonucleotide
ggaauuuguagaagggauaua

SEQ ID NO: 1655 - RNA, 21 nt, Artificial Sequence
  Synthetic oligonucleotide
gaauuuguagaagggauauac

SEQ ID NO: 1656 - RNA, 21 nt, Artificial Sequence
  Synthetic oligonucleotide
aauuuguagaagggauauaca

SEQ ID NO: 1657 - RNA, 21 nt, Artificial Sequence
  Synthetic oligonucleotide
auuuguagaagggauauacaa

SEQ ID NO: 1658 - RNA, 21 nt, Artificial Sequence
  Synthetic oligonucleotide
uuuguagaagggauauacaaa

SEQ ID NO: 1659 - RNA, 21 nt, Artificial Sequence
  Synthetic oligonucleotide
uuguagaagggauauacaaag

SEQ ID NO: 1660 - RNA, 21 nt, Artificial Sequence
  Synthetic oligonucleotide
uguagaagggauauacaaagu

SEQ ID NO: 1661 - RNA, 21 nt, Artificial Sequence
  Synthetic oligonucleotide
guagaagggauauacaaagug

SEQ ID NO: 1662 - RNA, 21 nt, Artificial Sequence
  Synthetic oligonucleotide
uagaagggauauacaaagugg

SEQ ID NO: 1663 - RNA, 21 nt, Artificial Sequence
  Synthetic oligonucleotide
agaagggauauacaaagugga

SEQ ID NO: 1664 - RNA, 21 nt, Artificial Sequence
  Synthetic oligonucleotide
gaagggauauacaaaguggaa

SEQ ID NO: 1665 - RNA, 21 nt, Artificial Sequence
  Synthetic oligonucleotide
aagggauauacaaaguggaaa

SEQ ID NO: 1666 - RNA, 21 nt, Artificial Sequence
  Synthetic oligonucleotide
agggauauacaaaguggaaau

SEQ ID NO: 1667 - RNA, 21 nt, Artificial Sequence
  Synthetic oligonucleotide
gggauauacaaaguggaaaua

SEQ ID NO: 1668 - RNA, 21 nt, Artificial Sequence
  Synthetic oligonucleotide
ggauauacaaaguggaaauag

SEQ ID NO: 1669 - RNA, 21 nt, Artificial Sequence
  Synthetic oligonucleotide
gauauacaaaguggaaauaga

SEQ ID NO: 1670 - RNA, 21 nt, Artificial Sequence
  Synthetic oligonucleotide
auauacaaaguggaaauagac

SEQ ID NO: 1671 - RNA, 21 nt, Artificial Sequence
  Synthetic oligonucleotide
uauacaaaguggaaauagaca

SEQ ID NO: 1672 - RNA, 21 nt, Artificial Sequence
  Synthetic oligonucleotide
auacaaaguggaaauagacac

SEQ ID NO: 1673 - RNA, 21 nt, Artificial Sequence
  Synthetic oligonucleotide
uacaaaguggaaauagacacc

SEQ ID NO: 1674 - RNA, 21 nt, Artificial Sequence
  Synthetic oligonucleotide
acaaaguggaaauagacacca

SEQ ID NO: 1675 - RNA, 21 nt, Artificial Sequence
  Synthetic oligonucleotide
caaaguggaaauagacaccaa

SEQ ID NO: 1676 - RNA, 21 nt, Artificial Sequence
  Synthetic oligonucleotide
aaaguggaaauagacaccaaa

SEQ ID NO: 1677 - RNA, 21 nt, Artificial Sequence
  Synthetic oligonucleotide
aaguggaaauagacaccaaau

SEQ ID NO: 1678 - RNA, 21 nt, Artificial Sequence
  Synthetic oligonucleotide
aguggaaauagacaccaaauc

SEQ ID NO: 1679 - RNA, 21 nt, Artificial Sequence
  Synthetic oligonucleotide
guggaaauagacaccaaaucu

SEQ ID NO: 1680 - RNA, 21 nt, Artificial Sequence
  Synthetic oligonucleotide
uggaaauagacaccaaaucuu

SEQ ID NO: 1681 - RNA, 21 nt, Artificial Sequence
  Synthetic oligonucleotide
ggaaauagacaccaaaucuua

SEQ ID NO: 1682 - RNA, 21 nt, Artificial Sequence
  Synthetic oligonucleotide
gaaauagacaccaaaucuuac

SEQ ID NO: 1683 - RNA, 21 nt, Artificial Sequence
  Synthetic oligonucleotide
aaauagacaccaaaucuuacu

SEQ ID NO: 1684 - RNA, 21 nt, Artificial Sequence
  Synthetic oligonucleotide
auagacaccaaaucuuacugg

SEQ ID NO: 1685 - RNA, 21 nt, Artificial Sequence
  Synthetic oligonucleotide
uagacaccaaaucuuacugga

SEQ ID NO: 1686 - RNA, 21 nt, Artificial Sequence
  Synthetic oligonucleotide
ggcacuuggcaucuccccauu

SEQ ID NO: 1687 - RNA, 21 nt, Artificial Sequence
  Synthetic oligonucleotide
gcacuuggcaucuccccauuc

SEQ ID NO: 1688 - RNA, 21 nt, Artificial Sequence
  Synthetic oligonucleotide
cacuuggcaucuccccauucc

SEQ ID NO: 1689 - RNA, 21 nt, Artificial Sequence
  Synthetic oligonucleotide
acuuggcaucuccccauucca

SEQ ID NO: 1690 - RNA, 21 nt, Artificial Sequence
  Synthetic oligonucleotide
cuuggcaucuccccauuccau

SEQ ID NO: 1691 - RNA, 21 nt, Artificial Sequence
  Synthetic oligonucleotide
uuggcaucuccccauuccaug

SEQ ID NO: 1692 - RNA, 21 nt, Artificial Sequence
  Synthetic oligonucleotide
uggcaucuccccauuccauga

SEQ ID NO: 1693 - RNA, 21 nt, Artificial Sequence
  Synthetic oligonucleotide
ggcaucuccccauuccaugag

SEQ ID NO: 1694 - RNA, 21 nt, Artificial Sequence
  Synthetic oligonucleotide
gcaucuccccauuccaugagc

SEQ ID NO: 1695 - RNA, 21 nt, Artificial Sequence
  Synthetic oligonucleotide
caucuccccauuccaugagca

SEQ ID NO: 1696 - RNA, 21 nt, Artificial Sequence
  Synthetic oligonucleotide
aucuccccauuccaugagcau

SEQ ID NO: 1697 - RNA, 21 nt, Artificial Sequence
  Synthetic oligonucleotide
ucuccccauuccaugagcaug

SEQ ID NO: 1698 - RNA, 21 nt, Artificial Sequence
  Synthetic oligonucleotide
cuccccauuccaugagcaugc

SEQ ID NO: 1699 - RNA, 21 nt, Artificial Sequence
  Synthetic oligonucleotide
uccaugagcaugcagaggugg

SEQ ID NO: 1700 - RNA, 21 nt, Artificial Sequence
  Synthetic oligonucleotide
ccaugagcaugcagagguggu

SEQ ID NO: 1701 - RNA, 21 nt, Artificial Sequence
  Synthetic oligonucleotide
caugagcaugcagagguggua

SEQ ID NO: 1702 - RNA, 21 nt, Artificial Sequence
  Synthetic oligonucleotide
augagcaugcagaggugguau

SEQ ID NO: 1703 - RNA, 21 nt, Artificial Sequence
  Synthetic oligonucleotide
gcaugcagaggugguauucac

SEQ ID NO: 1704 - RNA, 21 nt, Artificial Sequence
  Synthetic oligonucleotide
gcagaggugguauucacagcc

SEQ ID NO: 1705 - RNA, 21 nt, Artificial Sequence
  Synthetic oligonucleotide
cagaggugguauucacagcca

SEQ ID NO: 1706 - RNA, 21 nt, Artificial Sequence
  Synthetic oligonucleotide
cugucgucaccaaucccaagg

SEQ ID NO: 1707 - RNA, 21 nt, Artificial Sequence
  Synthetic oligonucleotide
aaggacgagggaugggauuuc

SEQ ID NO: 1708 - RNA, 21 nt, Artificial Sequence
  Synthetic oligonucleotide
aggacgagggaugggauuuca

SEQ ID NO: 1709 - RNA, 21 nt, Artificial Sequence
  Synthetic oligonucleotide
acgagggaugggauuucaugu

SEQ ID NO: 1710 - RNA, 21 nt, Artificial Sequence
  Synthetic oligonucleotide
cgagggaugggauuucaugua

SEQ ID NO: 1711 - RNA, 21 nt, Artificial Sequence
  Synthetic oligonucleotide
gagggaugggauuucauguaa

SEQ ID NO: 1712 - RNA, 21 nt, Artificial Sequence
  Synthetic oligonucleotide
gggaugggauuucauguaacc

SEQ ID NO: 1713 - RNA, 21 nt, Artificial Sequence
  Synthetic oligonucleotide
ggaugggauuucauguaacca

SEQ ID NO: 1714 - RNA, 21 nt, Artificial Sequence
  Synthetic oligonucleotide
gaugggauuucauguaaccaa

SEQ ID NO: 1715 - RNA, 21 nt, Artificial Sequence
  Synthetic oligonucleotide
augggauuucauguaaccaag

SEQ ID NO: 1716 - RNA, 21 nt, Artificial Sequence
  Synthetic oligonucleotide
ugggauuucauguaaccaaga

SEQ ID NO: 1717 - RNA, 21 nt, Artificial Sequence
  Synthetic oligonucleotide
gggauuucauguaaccaagag

SEQ ID NO: 1718 - RNA, 21 nt, Artificial Sequence
  Synthetic oligonucleotide
ggauuucauguaaccaagagu

SEQ ID NO: 1719 - RNA, 21 nt, Artificial Sequence
  Synthetic oligonucleotide
gauuucauguaaccaagagua

SEQ ID NO: 1720 - RNA, 21 nt, Artificial Sequence
  Synthetic oligonucleotide
auuucauguaaccaagaguau

SEQ ID NO: 1721 - RNA, 21 nt, Artificial Sequence
  Synthetic oligonucleotide
uuucauguaaccaagaguauu

SEQ ID NO: 1722 - RNA, 21 nt, Artificial Sequence
  Synthetic oligonucleotide
uucauguaaccaagaguauuc

SEQ ID NO: 1723 - RNA, 21 nt, Artificial Sequence
  Synthetic oligonucleotide
ucauguaaccaagaguauucc

SEQ ID NO: 1724 - RNA, 21 nt, Artificial Sequence
  Synthetic oligonucleotide
cauguaaccaagaguauucca

SEQ ID NO: 1725 - RNA, 21 nt, Artificial Sequence
  Synthetic oligonucleotide
auguaaccaagaguauuccau

SEQ ID NO: 1726 - RNA, 21 nt, Artificial Sequence
  Synthetic oligonucleotide
uguaaccaagaguauuccauu

SEQ ID NO: 1727 - RNA, 21 nt, Artificial Sequence
  Synthetic oligonucleotide
guaaccaagaguauuccauuu

SEQ ID NO: 1728 - RNA, 21 nt, Artificial Sequence
  Synthetic oligonucleotide
uaaccaagaguauuccauuuu

SEQ ID NO: 1729 - RNA, 21 nt, Artificial Sequence
  Synthetic oligonucleotide
aaccaagaguauuccauuuuu

SEQ ID NO: 1730 - RNA, 21 nt, Artificial Sequence
  Synthetic oligonucleotide
accaagaguauuccauuuuua

SEQ ID NO: 1731 - RNA, 21 nt, Artificial Sequence
  Synthetic oligonucleotide
ccaagaguauuccauuuuuac

SEQ ID NO: 1732 - RNA, 21 nt, Artificial Sequence
  Synthetic oligonucleotide
caagaguauuccauuuuuacu

SEQ ID NO: 1733 - RNA, 21 nt, Artificial Sequence
  Synthetic oligonucleotide
aagaguauuccauuuuuacua

SEQ ID NO: 1734 - RNA, 21 nt, Artificial Sequence
  Synthetic oligonucleotide
agaguauuccauuuuuacuaa

SEQ ID NO: 1735 - RNA, 21 nt, Artificial Sequence
  Synthetic oligonucleotide
gaguauuccauuuuuacuaaa

SEQ ID NO: 1736 - RNA, 21 nt, Artificial Sequence
  Synthetic oligonucleotide
aguauuccauuuuuacuaaag

SEQ ID NO: 1737 - RNA, 21 nt, Artificial Sequence
  Synthetic oligonucleotide
guauuccauuuuuacuaaagc

SEQ ID NO: 1738 - RNA, 21 nt, Artificial Sequence
  Synthetic oligonucleotide
uauuccauuuuuacuaaagca

SEQ ID NO: 1739 - RNA, 21 nt, Artificial Sequence
  Synthetic oligonucleotide
auuccauuuuuacuaaagcag

SEQ ID NO: 1740 - RNA, 21 nt, Artificial Sequence
  Synthetic oligonucleotide
uuccauuuuuacuaaagcagu

SEQ ID NO: 1741 - RNA, 21 nt, Artificial Sequence
  Synthetic oligonucleotide
uccauuuuuacuaaagcagug

SEQ ID NO: 1742 - RNA, 21 nt, Artificial Sequence
  Synthetic oligonucleotide
ccauuuuuacuaaagcagugu

SEQ ID NO: 1743 - RNA, 21 nt, Artificial Sequence
  Synthetic oligonucleotide
cauuuuuacuaaagcaguguu

SEQ ID NO: 1744 - RNA, 21 nt, Artificial Sequence
  Synthetic oligonucleotide
auuuuuacuaaagcaguguuu

SEQ ID NO: 1745 - RNA, 21 nt, Artificial Sequence
  Synthetic oligonucleotide
uuuuuacuaaagcaguguuuu

SEQ ID NO: 1746 - RNA, 21 nt, Artificial Sequence
  Synthetic oligonucleotide
uuuuacuaaagcaguguuuuc

SEQ ID NO: 1747 - RNA, 21 nt, Artificial Sequence
  Synthetic oligonucleotide
uuuacuaaagcaguguuuuca

SEQ ID NO: 1748 - RNA, 21 nt, Artificial Sequence
  Synthetic oligonucleotide
uuacuaaagcaguguuuucac

SEQ ID NO: 1749 - RNA, 21 nt, Artificial Sequence
  Synthetic oligonucleotide
uacuaaagcaguguuuucacc

SEQ ID NO: 1750 - RNA, 21 nt, Artificial Sequence
  Synthetic oligonucleotide
acuaaagcaguguuuucaccu

SEQ ID NO: 1751 - RNA, 21 nt, Artificial Sequence
  Synthetic oligonucleotide
cuaaagcaguguuuucaccuc

SEQ ID NO: 1752 - RNA, 21 nt, Artificial Sequence
  Synthetic oligonucleotide
uaaagcaguguuuucaccuca

SEQ ID NO: 1753 - RNA, 21 nt, Artificial Sequence
  Synthetic oligonucleotide
aaagcaguguuuucaccucau

SEQ ID NO: 1754 - RNA, 21 nt, Artificial Sequence
  Synthetic oligonucleotide
aagcaguguuuucaccucaua

SEQ ID NO: 1755 - RNA, 21 nt, Artificial Sequence
  Synthetic oligonucleotide
agcaguguuuucaccucauau

SEQ ID NO: 1756 - RNA, 21 nt, Artificial Sequence
  Synthetic oligonucleotide
gcaguguuuucaccucauaug

SEQ ID NO: 1757 - RNA, 21 nt, Artificial Sequence
  Synthetic oligonucleotide
caguguuuucaccucauaugc

SEQ ID NO: 1758 - RNA, 21 nt, Artificial Sequence
  Synthetic oligonucleotide
aguguuuucaccucauaugcu

SEQ ID NO: 1759 - RNA, 21 nt, Artificial Sequence
  Synthetic oligonucleotide
guguuuucaccucauaugcua

SEQ ID NO: 1760 - RNA, 21 nt, Artificial Sequence
  Synthetic oligonucleotide
uguuuucaccucauaugcuau

SEQ ID NO: 1761 - RNA, 21 nt, Artificial Sequence
  Synthetic oligonucleotide
guuuucaccucauaugcuaug

SEQ ID NO: 1762 - RNA, 21 nt, Artificial Sequence
  Synthetic oligonucleotide
uuuucaccucauaugcuaugu

SEQ ID NO: 1763 - RNA, 21 nt, Artificial Sequence
  Synthetic oligonucleotide
uuucaccucauaugcuauguu

SEQ ID NO: 1764 - RNA, 21 nt, Artificial Sequence
  Synthetic oligonucleotide
uucaccucauaugcuauguua

SEQ ID NO: 1765 - RNA, 21 nt, Artificial Sequence
  Synthetic oligonucleotide
ucaccucauaugcuauguuag

SEQ ID NO: 1766 - RNA, 21 nt, Artificial Sequence
  Synthetic oligonucleotide
caccucauaugcuauguuaga

SEQ ID NO: 1767 - RNA, 21 nt, Artificial Sequence
  Synthetic oligonucleotide
accucauaugcuauguuagaa

SEQ ID NO: 1768 - RNA, 21 nt, Artificial Sequence
  Synthetic oligonucleotide
ccucauaugcuauguuagaag

SEQ ID NO: 1769 - RNA, 21 nt, Artificial Sequence
  Synthetic oligonucleotide
cucauaugcuauguuagaagu

SEQ ID NO: 1770 - RNA, 21 nt, Artificial Sequence
  Synthetic oligonucleotide
ucauaugcuauguuagaaguc

SEQ ID NO: 1771 - RNA, 21 nt, Artificial Sequence
  Synthetic oligonucleotide
cauaugcuauguuagaagucc

SEQ ID NO: 1772 - RNA, 21 nt, Artificial Sequence
  Synthetic oligonucleotide
auaugcuauguuagaagucca

SEQ ID NO: 1773 - RNA, 21 nt, Artificial Sequence
  Synthetic oligonucleotide
ugcuauguuagaaguccaggc

SEQ ID NO: 1774 - RNA, 21 nt, Artificial Sequence
  Synthetic oligonucleotide
cuauguuagaaguccaggcag

SEQ ID NO: 1775 - RNA, 21 nt, Artificial Sequence
  Synthetic oligonucleotide
uauguuagaaguccaggcaga

SEQ ID NO: 1776 - RNA, 21 nt, Artificial Sequence
  Synthetic oligonucleotide
auguuagaaguccaggcagag

SEQ ID NO: 1777 - RNA, 21 nt, Artificial Sequence
  Synthetic oligonucleotide
uguuagaaguccaggcagaga

SEQ ID NO: 1778 - RNA, 21 nt, Artificial Sequence
  Synthetic oligonucleotide
guuagaaguccaggcagagac

SEQ ID NO: 1779 - RNA, 21 nt, Artificial Sequence
  Synthetic oligonucleotide
uuagaaguccaggcagagaca

SEQ ID NO: 1780 - RNA, 21 nt, Artificial Sequence
  Synthetic oligonucleotide
uagaaguccaggcagagacaa

SEQ ID NO: 1781 - RNA, 21 nt, Artificial Sequence
  Synthetic oligonucleotide
agaaguccaggcagagacaau

SEQ ID NO: 1782 - RNA, 21 nt, Artificial Sequence
  Synthetic oligonucleotide
gaaguccaggcagagacaaua

SEQ ID NO: 1783 - RNA, 21 nt, Artificial Sequence
  Synthetic oligonucleotide
aaguccaggcagagacaauaa

SEQ ID NO: 1784 - RNA, 21 nt, Artificial Sequence
  Synthetic oligonucleotide
aguccaggcagagacaauaaa

SEQ ID NO: 1785 - RNA, 21 nt, Artificial Sequence
  Synthetic oligonucleotide
uccaggcagagacaauaaaac

SEQ ID NO: 1786 - RNA, 21 nt, Artificial Sequence
  Synthetic oligonucleotide
ccaggcagagacaauaaaaca

SEQ ID NO: 1787 - RNA, 21 nt, Artificial Sequence
  Synthetic oligonucleotide
caggcagagacaauaaaacau

SEQ ID NO: 1788 - RNA, 21 nt, Artificial Sequence
  Synthetic oligonucleotide
aggcagagacaauaaaacauu

SEQ ID NO: 1789 - RNA, 21 nt, Artificial Sequence
  Synthetic oligonucleotide
ggcagagacaauaaaacauuc

SEQ ID NO: 1790 - RNA, 21 nt, Artificial Sequence
  Synthetic oligonucleotide
gcagagacaauaaaacauucc

SEQ ID NO: 1791 - RNA, 21 nt, Artificial Sequence
  Synthetic oligonucleotide
cagagacaauaaaacauuccu

SEQ ID NO: 1792 - RNA, 21 nt, Artificial Sequence
  Synthetic oligonucleotide
agagacaauaaaacauuccug

SEQ ID NO: 1793 - RNA, 21 nt, Artificial Sequence
  Synthetic oligonucleotide
gagacaauaaaacauuccugu

SEQ ID NO: 1794 - RNA, 21 nt, Artificial Sequence
  Synthetic oligonucleotide
agacaauaaaacauuccugug

SEQ ID NO: 1795 - RNA, 21 nt, Artificial Sequence
  Synthetic oligonucleotide
gacaauaaaacauuccuguga

SEQ ID NO: 1796 - RNA, 21 nt, Artificial Sequence
  Synthetic oligonucleotide
acaauaaaacauuccugugaa

SEQ ID NO: 1797 - RNA, 21 nt, Artificial Sequence
  Synthetic oligonucleotide
caauaaaacauuccugugaaa

SEQ ID NO: 1798 - RNA, 21 nt, Artificial Sequence
  Synthetic oligonucleotide
uaaaacauuccugugaaaggc

SEQ ID NO: 1799 - RNA, 21 nt, Artificial Sequence
  Synthetic oligonucleotide
aaaacauuccugugaaaggca

SEQ ID NO: 1800 - RNA, 21 nt, Artificial Sequence
  Synthetic oligonucleotide
aaacauuccugugaaaggcac

SEQ ID NO: 1801 - RNA, 21 nt, Artificial Sequence
  Synthetic oligonucleotide
aacauuccugugaaaggcacu

SEQ ID NO: 1802 - RNA, 21 nt, Artificial Sequence
  Synthetic oligonucleotide
acauuccugugaaaggcacuu

SEQ ID NO: 1803 - RNA, 21 nt, Artificial Sequence
  Synthetic oligonucleotide
cauuccugugaaaggcacuuu

SEQ ID NO: 1804 - RNA, 21 nt, Artificial Sequence
  Synthetic oligonucleotide
uuccugugaaaggcacuuuuc

SEQ ID NO: 1805 - RNA, 21 nt, Artificial Sequence
  Synthetic oligonucleotide
uccugugaaaggcacuuuuca

SEQ ID NO: 1806 - RNA, 21 nt, Artificial Sequence
  Synthetic oligonucleotide
ccugugaaaggcacuuuucau

SEQ ID NO: 1807 - RNA, 21 nt, Artificial Sequence
  Synthetic oligonucleotide
cugugaaaggcacuuuucauu

SEQ ID NO: 1808 - RNA, 21 nt, Artificial Sequence
  Synthetic oligonucleotide
ugugaaaggcacuuuucauuc

SEQ ID NO: 1809 - RNA, 21 nt, Artificial Sequence
  Synthetic oligonucleotide
gugaaaggcacuuuucauucc

SEQ ID NO: 1810 - RNA, 21 nt, Artificial Sequence
  Synthetic oligonucleotide
ugaaaggcacuuuucauucca

SEQ ID NO: 1811 - RNA, 21 nt, Artificial Sequence
  Synthetic oligonucleotide
gaaaggcacuuuucauuccac

SEQ ID NO: 1812 - RNA, 21 nt, Artificial Sequence
  Synthetic oligonucleotide
aaaggcacuuuucauuccacu

SEQ ID NO: 1813 - RNA, 21 nt, Artificial Sequence
  Synthetic oligonucleotide
aaggcacuuuucauuccacuu

SEQ ID NO: 1814 - RNA, 21 nt, Artificial Sequence
  Synthetic oligonucleotide
aggcacuuuucauuccacuuu

SEQ ID NO: 1815 - RNA, 21 nt, Artificial Sequence
  Synthetic oligonucleotide
ggcacuuuucauuccacuuua

SEQ ID NO: 1816 - RNA, 21 nt, Artificial Sequence
  Synthetic oligonucleotide
gcacuuuucauuccacuuuaa

SEQ ID NO: 1817 - RNA, 21 nt, Artificial Sequence
  Synthetic oligonucleotide
cacuuuucauuccacuuuaac

SEQ ID NO: 1818 - RNA, 21 nt, Artificial Sequence
  Synthetic oligonucleotide
acuuuucauuccacuuuaacu

SEQ ID NO: 1819 - RNA, 21 nt, Artificial Sequence
  Synthetic oligonucleotide
cuuuucauuccacuuuaacuu

SEQ ID NO: 1820 - RNA, 21 nt, Artificial Sequence
  Synthetic oligonucleotide
uuuucauuccacuuuaacuug

SEQ ID NO: 1821 - RNA, 21 nt, Artificial Sequence
  Synthetic oligonucleotide
uuucauuccacuuuaacuuga

SEQ ID NO: 1822 - RNA, 21 nt, Artificial Sequence
  Synthetic oligonucleotide
uucauuccacuuuaacuugau

SEQ ID NO: 1823 - RNA, 21 nt, Artificial Sequence
  Synthetic oligonucleotide
ucauuccacuuuaacuugauu

SEQ ID NO: 1824 - RNA, 21 nt, Artificial Sequence
  Synthetic oligonucleotide
cauuccacuuuaacuugauuu

SEQ ID NO: 1825 - RNA, 21 nt, Artificial Sequence
  Synthetic oligonucleotide
auuccacuuuaacuugauuuu

SEQ ID NO: 1826 - RNA, 21 nt, Artificial Sequence
  Synthetic oligonucleotide
uuccacuuuaacuugauuuuu

SEQ ID NO: 1827 - RNA, 21 nt, Artificial Sequence
  Synthetic oligonucleotide
uccacuuuaacuugauuuuuu

SEQ ID NO: 1828 - RNA, 21 nt, Artificial Sequence
  Synthetic oligonucleotide
ccacuuuaacuugauuuuuua

SEQ ID NO: 1829 - RNA, 21 nt, Artificial Sequence
  Synthetic oligonucleotide
cacuuuaacuugauuuuuuaa

SEQ ID NO: 1830 - RNA, 21 nt, Artificial Sequence
  Synthetic oligonucleotide
acuuuaacuugauuuuuuaaa

SEQ ID NO: 1831 - RNA, 21 nt, Artificial Sequence
  Synthetic oligonucleotide
cuuuaacuugauuuuuuaaau

SEQ ID NO: 1832 - RNA, 21 nt, Artificial Sequence
  Synthetic oligonucleotide
uuuaacuugauuuuuuaaauu

SEQ ID NO: 1833 - RNA, 21 nt, Artificial Sequence
  Synthetic oligonucleotide
uuaacuugauuuuuuaaauuc

SEQ ID NO: 1834 - RNA, 21 nt, Artificial Sequence
  Synthetic oligonucleotide
uaacuugauuuuuuaaauucc

SEQ ID NO: 1835 - RNA, 21 nt, Artificial Sequence
  Synthetic oligonucleotide
aacuugauuuuuuaaauuccc

SEQ ID NO: 1836 - RNA, 21 nt, Artificial Sequence
  Synthetic oligonucleotide
acuugauuuuuuaaauucccu

SEQ ID NO: 1837 - RNA, 21 nt, Artificial Sequence
  Synthetic oligonucleotide
cuugauuuuuuaaauucccuu

SEQ ID NO: 1838 - RNA, 21 nt, Artificial Sequence
  Synthetic oligonucleotide
uugauuuuuuaaauucccuua

SEQ ID NO: 1839 - RNA, 21 nt, Artificial Sequence
  Synthetic oligonucleotide
ugauuuuuuaaauucccuuau

SEQ ID NO: 1840 - RNA, 21 nt, Artificial Sequence
  Synthetic oligonucleotide
auuuuuuaaauucccuuauug

SEQ ID NO: 1841 - RNA, 21 nt, Artificial Sequence
  Synthetic oligonucleotide
uuaaauucccuuauugucccu

SEQ ID NO: 1842 - RNA, 21 nt, Artificial Sequence
  Synthetic oligonucleotide
uaaauucccuuauugucccuu

SEQ ID NO: 1843 - RNA, 21 nt, Artificial Sequence
  Synthetic oligonucleotide
auucccuuauugucccuucca

SEQ ID NO: 1844 - RNA, 21 nt, Artificial Sequence
  Synthetic oligonucleotide
aaaaaaagagaaucaaaauuu

SEQ ID NO: 1845 - RNA, 21 nt, Artificial Sequence
  Synthetic oligonucleotide
aaaaaagagaaucaaaauuuu

SEQ ID NO: 1846 - RNA, 21 nt, Artificial Sequence
  Synthetic oligonucleotide
aaaaagagaaucaaaauuuua

SEQ ID NO: 1847 - RNA, 21 nt, Artificial Sequence
  Synthetic oligonucleotide
aaaagagaaucaaaauuuuac

SEQ ID NO: 1848 - RNA, 21 nt, Artificial Sequence
  Synthetic oligonucleotide
aaagagaaucaaaauuuuaca

SEQ ID NO: 1849 - RNA, 21 nt, Artificial Sequence
  Synthetic oligonucleotide
aagagaaucaaaauuuuacaa

SEQ ID NO: 1850 - RNA, 21 nt, Artificial Sequence
  Synthetic oligonucleotide
agagaaucaaaauuuuacaaa

SEQ ID NO: 1851 - RNA, 21 nt, Artificial Sequence
  Synthetic oligonucleotide
gagaaucaaaauuuuacaaag

SEQ ID NO: 1852 - RNA, 21 nt, Artificial Sequence
  Synthetic oligonucleotide
agaaucaaaauuuuacaaaga

SEQ ID NO: 1853 - RNA, 21 nt, Artificial Sequence
  Synthetic oligonucleotide
gaaucaaaauuuuacaaagaa

SEQ ID NO: 1854 - RNA, 21 nt, Artificial Sequence
  Synthetic oligonucleotide
aaucaaaauuuuacaaagaau

SEQ ID NO: 1855 - RNA, 21 nt, Artificial Sequence
  Synthetic oligonucleotide
aucaaaauuuuacaaagaauc

SEQ ID NO: 1856 - RNA, 21 nt, Artificial Sequence
  Synthetic oligonucleotide
ucaaaauuuuacaaagaauca

SEQ ID NO: 1857 - RNA, 21 nt, Artificial Sequence
  Synthetic oligonucleotide
caaaauuuuacaaagaaucaa

SEQ ID NO: 1858 - RNA, 21 nt, Artificial Sequence
  Synthetic oligonucleotide
aaaauuuuacaaagaaucaaa

SEQ ID NO: 1859 - RNA, 21 nt, Artificial Sequence
  Synthetic oligonucleotide
aauuuuacaaagaaucaaagg

SEQ ID NO: 1860 - RNA, 21 nt, Artificial Sequence
  Synthetic oligonucleotide
auuuuacaaagaaucaaagga

SEQ ID NO: 1861 - RNA, 21 nt, Artificial Sequence
  Synthetic oligonucleotide
uuuuacaaagaaucaaaggaa

SEQ ID NO: 1862 - RNA, 21 nt, Artificial Sequence
  Synthetic oligonucleotide
uuuacaaagaaucaaaggaau

SEQ ID NO: 1863 - RNA, 21 nt, Artificial Sequence
  Synthetic oligonucleotide
uuacaaagaaucaaaggaauu

SEQ ID NO: 1864 - RNA, 21 nt, Artificial Sequence
  Synthetic oligonucleotide
uacaaagaaucaaaggaauuc

SEQ ID NO: 1865 - RNA, 21 nt, Artificial Sequence
  Synthetic oligonucleotide
acaaagaaucaaaggaauucu

SEQ ID NO: 1866 - RNA, 21 nt, Artificial Sequence
  Synthetic oligonucleotide
caaagaaucaaaggaauucua

SEQ ID NO: 1867 - RNA, 21 nt, Artificial Sequence
  Synthetic oligonucleotide
aaagaaucaaaggaauucuag

SEQ ID NO: 1868 - RNA, 21 nt, Artificial Sequence
  Synthetic oligonucleotide
aagaaucaaaggaauucuaga

SEQ ID NO: 1869 - RNA, 21 nt, Artificial Sequence
  Synthetic oligonucleotide
agaaucaaaggaauucuagaa

SEQ ID NO: 1870 - RNA, 21 nt, Artificial Sequence
  Synthetic oligonucleotide
gaaucaaaggaauucuagaaa

SEQ ID NO: 1871 - RNA, 21 nt, Artificial Sequence
  Synthetic oligonucleotide
aaucaaaggaauucuagaaag

SEQ ID NO: 1872 - RNA, 21 nt, Artificial Sequence
  Synthetic oligonucleotide
aucaaaggaauucuagaaagu

SEQ ID NO: 1873 - RNA, 21 nt, Artificial Sequence
  Synthetic oligonucleotide
ucaaaggaauucuagaaagua

SEQ ID NO: 1874 - RNA, 21 nt, Artificial Sequence
  Synthetic oligonucleotide
cuaggagagauccaaauuucc

SEQ ID NO: 1875 - RNA, 21 nt, Artificial Sequence
  Synthetic oligonucleotide
uaggagagauccaaauuucca

SEQ ID NO: 1876 - RNA, 21 nt, Artificial Sequence
  Synthetic oligonucleotide
gagagauccaaauuuccauug

SEQ ID NO: 1877 - RNA, 21 nt, Artificial Sequence
  Synthetic oligonucleotide
agagauccaaauuuccauugu

SEQ ID NO: 1878 - RNA, 21 nt, Artificial Sequence
  Synthetic oligonucleotide
gagauccaaauuuccauuguc

SEQ ID NO: 1879 - RNA, 21 nt, Artificial Sequence
  Synthetic oligonucleotide
agauccaaauuuccauugucu

SEQ ID NO: 1880 - RNA, 21 nt, Artificial Sequence
  Synthetic oligonucleotide
gauccaaauuuccauugucuu

SEQ ID NO: 1881 - RNA, 21 nt, Artificial Sequence
  Synthetic oligonucleotide
auccaaauuuccauugucuug

SEQ ID NO: 1882 - RNA, 21 nt, Artificial Sequence
  Synthetic oligonucleotide
uccaaauuuccauugucuugc

SEQ ID NO: 1883 - RNA, 21 nt, Artificial Sequence
  Synthetic oligonucleotide
ccaaauuuccauugucuugca

SEQ ID NO: 1884 - RNA, 21 nt, Artificial Sequence
  Synthetic oligonucleotide
caaauuuccauugucuugcaa

SEQ ID NO: 1885 - RNA, 21 nt, Artificial Sequence
  Synthetic oligonucleotide
aaauuuccauugucuugcaag

SEQ ID NO: 1886 - RNA, 21 nt, Artificial Sequence
  Synthetic oligonucleotide
aauuuccauugucuugcaagc

SEQ ID NO: 1887 - RNA, 21 nt, Artificial Sequence
  Synthetic oligonucleotide
auuuccauugucuugcaagca

SEQ ID NO: 1888 - RNA, 21 nt, Artificial Sequence
  Synthetic oligonucleotide
uuuccauugucuugcaagcaa

SEQ ID NO: 1889 - RNA, 21 nt, Artificial Sequence
  Synthetic oligonucleotide
uuccauugucuugcaagcaaa

SEQ ID NO: 1890 - RNA, 21 nt, Artificial Sequence
  Synthetic oligonucleotide
uccauugucuugcaagcaaag

SEQ ID NO: 1891 - RNA, 21 nt, Artificial Sequence
  Synthetic oligonucleotide
ccauugucuugcaagcaaagc

SEQ ID NO: 1892 - RNA, 21 nt, Artificial Sequence
  Synthetic oligonucleotide
cauugucuugcaagcaaagca

SEQ ID NO: 1893 - RNA, 21 nt, Artificial Sequence
  Synthetic oligonucleotide
auugucuugcaagcaaagcac

SEQ ID NO: 1894 - RNA, 21 nt, Artificial Sequence
  Synthetic oligonucleotide
uugucuugcaagcaaagcacg

SEQ ID NO: 1895 - RNA, 21 nt, Artificial Sequence
  Synthetic oligonucleotide
ugucuugcaagcaaagcacgu

SEQ ID NO: 1896 - RNA, 21 nt, Artificial Sequence
  Synthetic oligonucleotide
gucuugcaagcaaagcacgua

SEQ ID NO: 1897 - RNA, 21 nt, Artificial Sequence
  Synthetic oligonucleotide
ucuugcaagcaaagcacguau

SEQ ID NO: 1898 - RNA, 21 nt, Artificial Sequence
  Synthetic oligonucleotide
cuugcaagcaaagcacguauu

SEQ ID NO: 1899 - RNA, 21 nt, Artificial Sequence
  Synthetic oligonucleotide
uugcaagcaaagcacguauua

SEQ ID NO: 1900 - RNA, 21 nt, Artificial Sequence
  Synthetic oligonucleotide
ugcaagcaaagcacguauuaa

SEQ ID NO: 1901 - RNA, 21 nt, Artificial Sequence
  Synthetic oligonucleotide
gcaagcaaagcacguauuaaa

SEQ ID NO: 1902 - RNA, 21 nt, Artificial Sequence
  Synthetic oligonucleotide
caagcaaagcacguauuaaau

SEQ ID NO: 1903 - RNA, 21 nt, Artificial Sequence
  Synthetic oligonucleotide
aagcaaagcacguauuaaaua

SEQ ID NO: 1904 - RNA, 21 nt, Artificial Sequence
  Synthetic oligonucleotide
agcaaagcacguauuaaauau

SEQ ID NO: 1905 - RNA, 21 nt, Artificial Sequence
  Synthetic oligonucleotide
gcaaagcacguauuaaauaug

SEQ ID NO: 1906 - RNA, 21 nt, Artificial Sequence
  Synthetic oligonucleotide
caaagcacguauuaaauauga

SEQ ID NO: 1907 - RNA, 21 nt, Artificial Sequence
  Synthetic oligonucleotide
aaagcacguauuaaauaugau

SEQ ID NO: 1908 - RNA, 21 nt, Artificial Sequence
  Synthetic oligonucleotide
aagcacguauuaaauaugauc

SEQ ID NO: 1909 - RNA, 21 nt, Artificial Sequence
  Synthetic oligonucleotide
agcacguauuaaauaugaucu

SEQ ID NO: 1910 - RNA, 21 nt, Artificial Sequence
  Synthetic oligonucleotide
cacguauuaaauaugaucugc

SEQ ID NO: 1911 - RNA, 21 nt, Artificial Sequence
  Synthetic oligonucleotide
acguauuaaauaugaucugca

SEQ ID NO: 1912 - RNA, 21 nt, Artificial Sequence
  Synthetic oligonucleotide
guauuaaauaugaucugcagc

SEQ ID NO: 1913 - RNA, 21 nt, Artificial Sequence
  Synthetic oligonucleotide
uauuaaauaugaucugcagcc

SEQ ID NO: 1914 - RNA, 21 nt, Artificial Sequence
  Synthetic oligonucleotide
auuaaauaugaucugcagcca

SEQ ID NO: 1915 - RNA, 21 nt, Artificial Sequence
  Synthetic oligonucleotide
uuaaauaugaucugcagccau

SEQ ID NO: 1916 - RNA, 21 nt, Artificial Sequence
  Synthetic oligonucleotide
uaaauaugaucugcagccauu

SEQ ID NO: 1917 - RNA, 21 nt, Artificial Sequence
  Synthetic oligonucleotide
aaauaugaucugcagccauua

SEQ ID NO: 1918 - RNA, 21 nt, Artificial Sequence
  Synthetic oligonucleotide
aauaugaucugcagccauuaa

SEQ ID NO: 1919 - RNA, 21 nt, Artificial Sequence
  Synthetic oligonucleotide
auaugaucugcagccauuaaa

SEQ ID NO: 1920 - RNA, 21 nt, Artificial Sequence
  Synthetic oligonucleotide
uaugaucugcagccauuaaaa

SEQ ID NO: 1921 - RNA, 27 nt, Artificial Sequence
  Synthetic oligonucleotide
guugacuaagucaauaaucagaaucag

SEQ ID NO: 1922 - RNA, 27 nt, Artificial Sequence
  Synthetic oligonucleotide
uugacuaagucaauaaucagaaucagc

SEQ ID NO: 1923 - RNA, 27 nt, Artificial Sequence
  Synthetic oligonucleotide
ugacuaagucaauaaucagaaucagca

SEQ ID NO: 1924 - RNA, 27 nt, Artificial Sequence
  Synthetic oligonucleotide
gacuaagucaauaaucagaaucagcag

SEQ ID NO: 1925 - RNA, 27 nt, Artificial Sequence
  Synthetic oligonucleotide
acuaagucaauaaucagaaucagcagg

SEQ ID NO: 1926 - RNA, 27 nt, Artificial Sequence
  Synthetic oligonucleotide
cuaagucaauaaucagaaucagcaggu

SEQ ID NO: 1927 - RNA, 27 nt, Artificial Sequence
  Synthetic oligonucleotide
uaagucaauaaucagaaucagcagguu

SEQ ID NO: 1928 - RNA, 27 nt, Artificial Sequence
  Synthetic oligonucleotide
aagucaauaaucagaaucagcagguuu

SEQ ID NO: 1929 - RNA, 27 nt, Artificial Sequence
  Synthetic oligonucleotide
agucaauaaucagaaucagcagguuug

SEQ ID NO: 1930 - RNA, 27 nt, Artificial Sequence
  Synthetic oligonucleotide
gucaauaaucagaaucagcagguuugc

SEQ ID NO: 1931 - RNA, 27 nt, Artificial Sequence
  Synthetic oligonucleotide
ucaauaaucagaaucagcagguuugca

SEQ ID NO: 1932 - RNA, 27 nt, Artificial Sequence
  Synthetic oligonucleotide
caauaaucagaaucagcagguuugcag

SEQ ID NO: 1933 - RNA, 27 nt, Artificial Sequence
  Synthetic oligonucleotide
aauaaucagaaucagcagguuugcagu

SEQ ID NO: 1934 - RNA, 27 nt, Artificial Sequence
  Synthetic oligonucleotide
auaaucagaaucagcagguuugcaguc

SEQ ID NO: 1935 - RNA, 27 nt, Artificial Sequence
  Synthetic oligonucleotide
uaaucagaaucagcagguuugcaguca

SEQ ID NO: 1936 - RNA, 27 nt, Artificial Sequence
  Synthetic oligonucleotide
aucagaaucagcagguuugcagucaga

SEQ ID NO: 1937 - RNA, 27 nt, Artificial Sequence
  Synthetic oligonucleotide
ucagaaucagcagguuugcagucagau

SEQ ID NO: 1938 - RNA, 27 nt, Artificial Sequence
  Synthetic oligonucleotide
agaaucagcagguuugcagucagauug

SEQ ID NO: 1939 - RNA, 27 nt, Artificial Sequence
  Synthetic oligonucleotide
gaaucagcagguuugcagucagauugg

SEQ ID NO: 1940 - RNA, 27 nt, Artificial Sequence
  Synthetic oligonucleotide
uugcagucagauuggcagggauaagca

SEQ ID NO: 1941 - RNA, 27 nt, Artificial Sequence
  Synthetic oligonucleotide
cagccuagcucaggagaagugaguaua

SEQ ID NO: 1942 - RNA, 27 nt, Artificial Sequence
  Synthetic oligonucleotide
ccuagcucaggagaagugaguauaaaa

SEQ ID NO: 1943 - RNA, 27 nt, Artificial Sequence
  Synthetic oligonucleotide
cuagcucaggagaagugaguauaaaag

SEQ ID NO: 1944 - RNA, 27 nt, Artificial Sequence
  Synthetic oligonucleotide
uagcucaggagaagugaguauaaaagc

SEQ ID NO: 1945 - RNA, 27 nt, Artificial Sequence
  Synthetic oligonucleotide
agcucaggagaagugaguauaaaagcc

SEQ ID NO: 1946 - RNA, 27 nt, Artificial Sequence
  Synthetic oligonucleotide
cucaggagaagugaguauaaaagcccc

SEQ ID NO: 1947 - RNA, 27 nt, Artificial Sequence
  Synthetic oligonucleotide
gagcagccaucacagaaguccacucau

SEQ ID NO: 1948 - RNA, 27 nt, Artificial Sequence
  Synthetic oligonucleotide
agcagccaucacagaaguccacucauu

SEQ ID NO: 1949 - RNA, 27 nt, Artificial Sequence
  Synthetic oligonucleotide
gcagccaucacagaaguccacucauuc

SEQ ID NO: 1950 - RNA, 27 nt, Artificial Sequence
  Synthetic oligonucleotide
cagccaucacagaaguccacucauucu

SEQ ID NO: 1951 - RNA, 27 nt, Artificial Sequence
  Synthetic oligonucleotide
agccaucacagaaguccacucauucuu

SEQ ID NO: 1952 - RNA, 27 nt, Artificial Sequence
  Synthetic oligonucleotide
gccaucacagaaguccacucauucuug

SEQ ID NO: 1953 - RNA, 27 nt, Artificial Sequence
  Synthetic oligonucleotide
ccaucacagaaguccacucauucuugg

SEQ ID NO: 1954 - RNA, 27 nt, Artificial Sequence
  Synthetic oligonucleotide
aucacagaaguccacucauucuuggca

SEQ ID NO: 1955 - RNA, 27 nt, Artificial Sequence
  Synthetic oligonucleotide
ucacagaaguccacucauucuuggcag

SEQ ID NO: 1956 - RNA, 27 nt, Artificial Sequence
  Synthetic oligonucleotide
cauucuuggcaggauggcuucucaucg

SEQ ID NO: 1957 - RNA, 27 nt, Artificial Sequence
  Synthetic oligonucleotide
auucuuggcaggauggcuucucaucgu

SEQ ID NO: 1958 - RNA, 27 nt, Artificial Sequence
  Synthetic oligonucleotide
uucuuggcaggauggcuucucaucguc

SEQ ID NO: 1959 - RNA, 27 nt, Artificial Sequence
  Synthetic oligonucleotide
ucuuggcaggauggcuucucaucgucu

SEQ ID NO: 1960 - RNA, 27 nt, Artificial Sequence
  Synthetic oligonucleotide
cuuggcaggauggcuucucaucgucug

SEQ ID NO: 1961 - RNA, 27 nt, Artificial Sequence
  Synthetic oligonucleotide
uuggcaggauggcuucucaucgucugc

SEQ ID NO: 1962 - RNA, 27 nt, Artificial Sequence
  Synthetic oligonucleotide
uggcaggauggcuucucaucgucugcu

SEQ ID NO: 1963 - RNA, 27 nt, Artificial Sequence
  Synthetic oligonucleotide
ggcaggauggcuucucaucgucugcuc

SEQ ID NO: 1964 - RNA, 27 nt, Artificial Sequence
  Synthetic oligonucleotide
gcaggauggcuucucaucgucugcucc

SEQ ID NO: 1965 - RNA, 27 nt, Artificial Sequence
  Synthetic oligonucleotide
caggauggcuucucaucgucugcuccu

SEQ ID NO: 1966 - RNA, 27 nt, Artificial Sequence
  Synthetic oligonucleotide
aggauggcuucucaucgucugcuccuc

SEQ ID NO: 1967 - RNA, 27 nt, Artificial Sequence
  Synthetic oligonucleotide
ggauggcuucucaucgucugcuccucc

SEQ ID NO: 1968 - RNA, 27 nt, Artificial Sequence
  Synthetic oligonucleotide
gauggcuucucaucgucugcuccuccu

SEQ ID NO: 1969 - RNA, 27 nt, Artificial Sequence
  Synthetic oligonucleotide
auggcuucucaucgucugcuccuccuc

SEQ ID NO: 1970 - RNA, 27 nt, Artificial Sequence
  Synthetic oligonucleotide
uggcuucucaucgucugcuccuccucu

SEQ ID NO: 1971 - RNA, 27 nt, Artificial Sequence
  Synthetic oligonucleotide
ggcuucucaucgucugcuccuccucug

SEQ ID NO: 1972 - RNA, 27 nt, Artificial Sequence
  Synthetic oligonucleotide
ccucugccuugcuggacugguauuugu

SEQ ID NO: 1973 - RNA, 27 nt, Artificial Sequence
  Synthetic oligonucleotide
cucugccuugcuggacugguauuugug

SEQ ID NO: 1974 - RNA, 27 nt, Artificial Sequence
  Synthetic oligonucleotide
caccggugaauccaaguguccucugau

SEQ ID NO: 1975 - RNA, 27 nt, Artificial Sequence
  Synthetic oligonucleotide
ggugaauccaaguguccucugaugguc

SEQ ID NO: 1976 - RNA, 27 nt, Artificial Sequence
  Synthetic oligonucleotide
gugaauccaaguguccucugaugguca

SEQ ID NO: 1977 - RNA, 27 nt, Artificial Sequence
  Synthetic oligonucleotide
ugaauccaaguguccucugauggucaa

SEQ ID NO: 1978 - RNA, 27 nt, Artificial Sequence
  Synthetic oligonucleotide
gaauccaaguguccucugauggucaaa

SEQ ID NO: 1979 - RNA, 27 nt, Artificial Sequence
  Synthetic oligonucleotide
aauccaaguguccucugauggucaaag

SEQ ID NO: 1980 - RNA, 27 nt, Artificial Sequence
  Synthetic oligonucleotide
auccaaguguccucugauggucaaagu

SEQ ID NO: 1981 - RNA, 27 nt, Artificial Sequence
  Synthetic oligonucleotide
uccaaguguccucugauggucaaaguu

SEQ ID NO: 1982 - RNA, 27 nt, Artificial Sequence
  Synthetic oligonucleotide
ccaaguguccucugauggucaaaguuc

SEQ ID NO: 1983 - RNA, 27 nt, Artificial Sequence
  Synthetic oligonucleotide
caaguguccucugauggucaaaguucu

SEQ ID NO: 1984 - RNA, 27 nt, Artificial Sequence
  Synthetic oligonucleotide
aaguguccucugauggucaaaguucua

SEQ ID NO: 1985 - RNA, 27 nt, Artificial Sequence
  Synthetic oligonucleotide
aguguccucugauggucaaaguucuag

SEQ ID NO: 1986 - RNA, 27 nt, Artificial Sequence
  Synthetic oligonucleotide
guguccucugauggucaaaguucuaga

SEQ ID NO: 1987 - RNA, 27 nt, Artificial Sequence
  Synthetic oligonucleotide
uguccucugauggucaaaguucuagau

SEQ ID NO: 1988 - RNA, 27 nt, Artificial Sequence
  Synthetic oligonucleotide
guccucugauggucaaaguucuagaug

SEQ ID NO: 1989 - RNA, 27 nt, Artificial Sequence
  Synthetic oligonucleotide
uccucugauggucaaaguucuagaugc

SEQ ID NO: 1990 - RNA, 27 nt, Artificial Sequence
  Synthetic oligonucleotide
ccucugauggucaaaguucuagaugcu

SEQ ID NO: 1991 - RNA, 27 nt, Artificial Sequence
  Synthetic oligonucleotide
cucugauggucaaaguucuagaugcug

SEQ ID NO: 1992 - RNA, 27 nt, Artificial Sequence
  Synthetic oligonucleotide
ucugauggucaaaguucuagaugcugu

SEQ ID NO: 1993 - RNA, 27 nt, Artificial Sequence
  Synthetic oligonucleotide
cugauggucaaaguucuagaugcuguc

SEQ ID NO: 1994 - RNA, 27 nt, Artificial Sequence
  Synthetic oligonucleotide
ugauggucaaaguucuagaugcugucc

SEQ ID NO: 1995 - RNA, 27 nt, Artificial Sequence
  Synthetic oligonucleotide
gauggucaaaguucuagaugcuguccg

SEQ ID NO: 1996 - RNA, 27 nt, Artificial Sequence
  Synthetic oligonucleotide
gagccauuugccucugggaaaaccagu

SEQ ID NO: 1997 - RNA, 27 nt, Artificial Sequence
  Synthetic oligonucleotide
agccauuugccucugggaaaaccagug

SEQ ID NO: 1998 - RNA, 27 nt, Artificial Sequence
  Synthetic oligonucleotide
gccauuugccucugggaaaaccaguga

SEQ ID NO: 1999 - RNA, 27 nt, Artificial Sequence
  Synthetic oligonucleotide
ccauuugccucugggaaaaccagugag

SEQ ID NO: 2000 - RNA, 27 nt, Artificial Sequence
  Synthetic oligonucleotide
cauuugccucugggaaaaccagugagu

SEQ ID NO: 2001 - RNA, 27 nt, Artificial Sequence
  Synthetic oligonucleotide
auuugccucugggaaaaccagugaguc

SEQ ID NO: 2002 - RNA, 27 nt, Artificial Sequence
  Synthetic oligonucleotide
uuugccucugggaaaaccagugagucu

SEQ ID NO: 2003 - RNA, 27 nt, Artificial Sequence
  Synthetic oligonucleotide
uugccucugggaaaaccagugagucug

SEQ ID NO: 2004 - RNA, 27 nt, Artificial Sequence
  Synthetic oligonucleotide
ugccucugggaaaaccagugagucugg

SEQ ID NO: 2005 - RNA, 27 nt, Artificial Sequence
  Synthetic oligonucleotide
gccucugggaaaaccagugagucugga

SEQ ID NO: 2006 - RNA, 27 nt, Artificial Sequence
  Synthetic oligonucleotide
ccucugggaaaaccagugagucuggag

SEQ ID NO: 2007 - RNA, 27 nt, Artificial Sequence
  Synthetic oligonucleotide
cucugggaaaaccagugagucuggaga

SEQ ID NO: 2008 - RNA, 27 nt, Artificial Sequence
  Synthetic oligonucleotide
ucugggaaaaccagugagucuggagag

SEQ ID NO: 2009 - RNA, 27 nt, Artificial Sequence
  Synthetic oligonucleotide
cugggaaaaccagugagucuggagagc

SEQ ID NO: 2010 - RNA, 27 nt, Artificial Sequence
  Synthetic oligonucleotide
ugggaaaaccagugagucuggagagcu

SEQ ID NO: 2011 - RNA, 27 nt, Artificial Sequence
  Synthetic oligonucleotide
gggaaaaccagugagucuggagagcug

SEQ ID NO: 2012 - RNA, 27 nt, Artificial Sequence
  Synthetic oligonucleotide
agagcugcaugggcucacaacugagga

SEQ ID NO: 2013 - RNA, 27 nt, Artificial Sequence
  Synthetic oligonucleotide
gagcugcaugggcucacaacugaggag

SEQ ID NO: 2014 - RNA, 27 nt, Artificial Sequence
  Synthetic oligonucleotide
agcugcaugggcucacaacugaggagg

SEQ ID NO: 2015 - RNA, 27 nt, Artificial Sequence
  Synthetic oligonucleotide
gcugcaugggcucacaacugaggagga

SEQ ID NO: 2016 - RNA, 27 nt, Artificial Sequence
  Synthetic oligonucleotide
cugcaugggcucacaacugaggaggaa

SEQ ID NO: 2017 - RNA, 27 nt, Artificial Sequence
  Synthetic oligonucleotide
ugcaugggcucacaacugaggaggaau

SEQ ID NO: 2018 - RNA, 27 nt, Artificial Sequence
  Synthetic oligonucleotide
gcaugggcucacaacugaggaggaauu

SEQ ID NO: 2019 - RNA, 27 nt, Artificial Sequence
  Synthetic oligonucleotide
caugggcucacaacugaggaggaauuu

SEQ ID NO: 2020 - RNA, 27 nt, Artificial Sequence
  Synthetic oligonucleotide
augggcucacaacugaggaggaauuug

SEQ ID NO: 2021 - RNA, 27 nt, Artificial Sequence
  Synthetic oligonucleotide
ugggcucacaacugaggaggaauuugu

SEQ ID NO: 2022 - RNA, 27 nt, Artificial Sequence
  Synthetic oligonucleotide
gggcucacaacugaggaggaauuugua

SEQ ID NO: 2023 - RNA, 27 nt, Artificial Sequence
  Synthetic oligonucleotide
ggcucacaacugaggaggaauuuguag

SEQ ID NO: 2024 - RNA, 27 nt, Artificial Sequence
  Synthetic oligonucleotide
gcucacaacugaggaggaauuuguaga

SEQ ID NO: 2025 - RNA, 27 nt, Artificial Sequence
  Synthetic oligonucleotide
cucacaacugaggaggaauuuguagaa

SEQ ID NO: 2026 - RNA, 27 nt, Artificial Sequence
  Synthetic oligonucleotide
ucacaacugaggaggaauuuguagaag

SEQ ID NO: 2027 - RNA, 27 nt, Artificial Sequence
  Synthetic oligonucleotide
cacaacugaggaggaauuuguagaagg

SEQ ID NO: 2028 - RNA, 27 nt, Artificial Sequence
  Synthetic oligonucleotide
caacugaggaggaauuuguagaaggga

SEQ ID NO: 2029 - RNA, 27 nt, Artificial Sequence
  Synthetic oligonucleotide
aacugaggaggaauuuguagaagggau

SEQ ID NO: 2030 - RNA, 27 nt, Artificial Sequence
  Synthetic oligonucleotide
acugaggaggaauuuguagaagggaua

SEQ ID NO: 2031 - RNA, 27 nt, Artificial Sequence
  Synthetic oligonucleotide
cugaggaggaauuuguagaagggauau

SEQ ID NO: 2032 - RNA, 27 nt, Artificial Sequence
  Synthetic oligonucleotide
ugaggaggaauuuguagaagggauaua

SEQ ID NO: 2033 - RNA, 27 nt, Artificial Sequence
  Synthetic oligonucleotide
gaggaggaauuuguagaagggauauac

SEQ ID NO: 2034 - RNA, 27 nt, Artificial Sequence
  Synthetic oligonucleotide
aggaggaauuuguagaagggauauaca

SEQ ID NO: 2035 - RNA, 27 nt, Artificial Sequence
  Synthetic oligonucleotide
ggaggaauuuguagaagggauauacaa

SEQ ID NO: 2036 - RNA, 27 nt, Artificial Sequence
  Synthetic oligonucleotide
gaggaauuuguagaagggauauacaaa

SEQ ID NO: 2037 - RNA, 27 nt, Artificial Sequence
  Synthetic oligonucleotide
aggaauuuguagaagggauauacaaag

SEQ ID NO: 2038 - RNA, 27 nt, Artificial Sequence
  Synthetic oligonucleotide
ggaauuuguagaagggauauacaaagu

SEQ ID NO: 2039 - RNA, 27 nt, Artificial Sequence
  Synthetic oligonucleotide
gaauuuguagaagggauauacaaagug

SEQ ID NO: 2040 - RNA, 27 nt, Artificial Sequence
  Synthetic oligonucleotide
aauuuguagaagggauauacaaagugg

SEQ ID NO: 2041 - RNA, 27 nt, Artificial Sequence
  Synthetic oligonucleotide
auuuguagaagggauauacaaagugga

SEQ ID NO: 2042 - RNA, 27 nt, Artificial Sequence
  Synthetic oligonucleotide
uuuguagaagggauauacaaaguggaa

SEQ ID NO: 2043 - RNA, 27 nt, Artificial Sequence
  Synthetic oligonucleotide
uuguagaagggauauacaaaguggaaa

SEQ ID NO: 2044 - RNA, 27 nt, Artificial Sequence
  Synthetic oligonucleotide
uguagaagggauauacaaaguggaaau

SEQ ID NO: 2045 - RNA, 27 nt, Artificial Sequence
  Synthetic oligonucleotide
guagaagggauauacaaaguggaaaua

SEQ ID NO: 2046 - RNA, 27 nt, Artificial Sequence
  Synthetic oligonucleotide
uagaagggauauacaaaguggaaauag

SEQ ID NO: 2047 - RNA, 27 nt, Artificial Sequence
  Synthetic oligonucleotide
agaagggauauacaaaguggaaauaga

SEQ ID NO: 2048 - RNA, 27 nt, Artificial Sequence
  Synthetic oligonucleotide
gaagggauauacaaaguggaaauagac

SEQ ID NO: 2049 - RNA, 27 nt, Artificial Sequence
  Synthetic oligonucleotide
aagggauauacaaaguggaaauagaca

SEQ ID NO: 2050 - RNA, 27 nt, Artificial Sequence
  Synthetic oligonucleotide
agggauauacaaaguggaaauagacac

SEQ ID NO: 2051 - RNA, 27 nt, Artificial Sequence
  Synthetic oligonucleotide
gggauauacaaaguggaaauagacacc

SEQ ID NO: 2052 - RNA, 27 nt, Artificial Sequence
  Synthetic oligonucleotide
ggauauacaaaguggaaauagacacca

SEQ ID NO: 2053 - RNA, 27 nt, Artificial Sequence
  Synthetic oligonucleotide
gauauacaaaguggaaauagacaccaa

SEQ ID NO: 2054 - RNA, 27 nt, Artificial Sequence
  Synthetic oligonucleotide
auauacaaaguggaaauagacaccaaa

SEQ ID NO: 2055 - RNA, 27 nt, Artificial Sequence
  Synthetic oligonucleotide
uauacaaaguggaaauagacaccaaau

SEQ ID NO: 2056 - RNA, 27 nt, Artificial Sequence
  Synthetic oligonucleotide
auacaaaguggaaauagacaccaaauc

SEQ ID NO: 2057 - RNA, 27 nt, Artificial Sequence
  Synthetic oligonucleotide
uacaaaguggaaauagacaccaaaucu

SEQ ID NO: 2058 - RNA, 27 nt, Artificial Sequence
  Synthetic oligonucleotide
acaaaguggaaauagacaccaaaucuu

SEQ ID NO: 2059 - RNA, 27 nt, Artificial Sequence
  Synthetic oligonucleotide
caaaguggaaauagacaccaaaucuua

SEQ ID NO: 2060 - RNA, 27 nt, Artificial Sequence
  Synthetic oligonucleotide
aaaguggaaauagacaccaaaucuuac

SEQ ID NO: 2061 - RNA, 27 nt, Artificial Sequence
  Synthetic oligonucleotide
aaguggaaauagacaccaaaucuuacu

SEQ ID NO: 2062 - RNA, 27 nt, Artificial Sequence
  Synthetic oligonucleotide
aguggaaauagacaccaaaucuuacug

SEQ ID NO: 2063 - RNA, 27 nt, Artificial Sequence
  Synthetic oligonucleotide
guggaaauagacaccaaaucuuacugg

SEQ ID NO: 2064 - RNA, 27 nt, Artificial Sequence
  Synthetic oligonucleotide
uggaaauagacaccaaaucuuacugga

SEQ ID NO: 2065 - RNA, 27 nt, Artificial Sequence
  Synthetic oligonucleotide
ggaaauagacaccaaaucuuacuggaa

SEQ ID NO: 2066 - RNA, 27 nt, Artificial Sequence
  Synthetic oligonucleotide
gaaauagacaccaaaucuuacuggaag

SEQ ID NO: 2067 - RNA, 27 nt, Artificial Sequence
  Synthetic oligonucleotide
aaauagacaccaaaucuuacuggaagg

SEQ ID NO: 2068 - RNA, 27 nt, Artificial Sequence
  Synthetic oligonucleotide
auagacaccaaaucuuacuggaaggca

SEQ ID NO: 2069 - RNA, 27 nt, Artificial Sequence
  Synthetic oligonucleotide
uagacaccaaaucuuacuggaaggcac

SEQ ID NO: 2070 - RNA, 27 nt, Artificial Sequence
  Synthetic oligonucleotide
ggcacuuggcaucuccccauuccauga

SEQ ID NO: 2071 - RNA, 27 nt, Artificial Sequence
  Synthetic oligonucleotide
gcacuuggcaucuccccauuccaugag

SEQ ID NO: 2072 - RNA, 27 nt, Artificial Sequence
  Synthetic oligonucleotide
cacuuggcaucuccccauuccaugagc

SEQ ID NO: 2073 - RNA, 27 nt, Artificial Sequence
  Synthetic oligonucleotide
acuuggcaucuccccauuccaugagca

SEQ ID NO: 2074 - RNA, 27 nt, Artificial Sequence
  Synthetic oligonucleotide
cuuggcaucuccccauuccaugagcau

SEQ ID NO: 2075 - RNA, 27 nt, Artificial Sequence
  Synthetic oligonucleotide
uuggcaucuccccauuccaugagcaug

SEQ ID NO: 2076 - RNA, 27 nt, Artificial Sequence
  Synthetic oligonucleotide
uggcaucuccccauuccaugagcaugc

SEQ ID NO: 2077 - RNA, 27 nt, Artificial Sequence
  Synthetic oligonucleotide
ggcaucuccccauuccaugagcaugca

SEQ ID NO: 2078 - RNA, 27 nt, Artificial Sequence
  Synthetic oligonucleotide
gcaucuccccauuccaugagcaugcag

SEQ ID NO: 2079 - RNA, 27 nt, Artificial Sequence
  Synthetic oligonucleotide
caucuccccauuccaugagcaugcaga

SEQ ID NO: 2080 - RNA, 27 nt, Artificial Sequence
  Synthetic oligonucleotide
aucuccccauuccaugagcaugcagag

SEQ ID NO: 2081 - RNA, 27 nt, Artificial Sequence
  Synthetic oligonucleotide
ucuccccauuccaugagcaugcagagg

SEQ ID NO: 2082 - RNA, 27 nt, Artificial Sequence
  Synthetic oligonucleotide
cuccccauuccaugagcaugcagaggu

SEQ ID NO: 2083 - RNA, 27 nt, Artificial Sequence
  Synthetic oligonucleotide
uccaugagcaugcagaggugguauuca

SEQ ID NO: 2084 - RNA, 27 nt, Artificial Sequence
  Synthetic oligonucleotide
ccaugagcaugcagaggugguauucac

SEQ ID NO: 2085 - RNA, 27 nt, Artificial Sequence
  Synthetic oligonucleotide
caugagcaugcagaggugguauucaca

SEQ ID NO: 2086 - RNA, 27 nt, Artificial Sequence
  Synthetic oligonucleotide
augagcaugcagaggugguauucacag

SEQ ID NO: 2087 - RNA, 27 nt, Artificial Sequence
  Synthetic oligonucleotide
gcaugcagaggugguauucacagccaa

SEQ ID NO: 2088 - RNA, 27 nt, Artificial Sequence
  Synthetic oligonucleotide
gcagaggugguauucacagccaacgac

SEQ ID NO: 2089 - RNA, 27 nt, Artificial Sequence
  Synthetic oligonucleotide
cagaggugguauucacagccaacgacu

SEQ ID NO: 2090 - RNA, 27 nt, Artificial Sequence
  Synthetic oligonucleotide
cugucgucaccaaucccaaggaaugag

SEQ ID NO: 2091 - RNA, 27 nt, Artificial Sequence
  Synthetic oligonucleotide
aaggacgagggaugggauuucauguaa

SEQ ID NO: 2092 - RNA, 27 nt, Artificial Sequence
  Synthetic oligonucleotide
aggacgagggaugggauuucauguaac

SEQ ID NO: 2093 - RNA, 27 nt, Artificial Sequence
  Synthetic oligonucleotide
acgagggaugggauuucauguaaccaa

SEQ ID NO: 2094 - RNA, 27 nt, Artificial Sequence
  Synthetic oligonucleotide
cgagggaugggauuucauguaaccaag

SEQ ID NO: 2095 - RNA, 27 nt, Artificial Sequence
  Synthetic oligonucleotide
gagggaugggauuucauguaaccaaga

SEQ ID NO: 2096 - RNA, 27 nt, Artificial Sequence
  Synthetic oligonucleotide
gggaugggauuucauguaaccaagagu

SEQ ID NO: 2097 - RNA, 27 nt, Artificial Sequence
  Synthetic oligonucleotide
ggaugggauuucauguaaccaagagua

SEQ ID NO: 2098 - RNA, 27 nt, Artificial Sequence
  Synthetic oligonucleotide
gaugggauuucauguaaccaagaguau

SEQ ID NO: 2099 - RNA, 27 nt, Artificial Sequence
  Synthetic oligonucleotide
augggauuucauguaaccaagaguauu

SEQ ID NO: 2100 - RNA, 27 nt, Artificial Sequence
  Synthetic oligonucleotide
ugggauuucauguaaccaagaguauuc

SEQ ID NO: 2101 - RNA, 27 nt, Artificial Sequence
  Synthetic oligonucleotide
gggauuucauguaaccaagaguauucc

SEQ ID NO: 2102 - RNA, 27 nt, Artificial Sequence
  Synthetic oligonucleotide
ggauuucauguaaccaagaguauucca

SEQ ID NO: 2103 - RNA, 27 nt, Artificial Sequence
  Synthetic oligonucleotide
gauuucauguaaccaagaguauuccau

SEQ ID NO: 2104 - RNA, 27 nt, Artificial Sequence
  Synthetic oligonucleotide
auuucauguaaccaagaguauuccauu

SEQ ID NO: 2105 - RNA, 27 nt, Artificial Sequence
  Synthetic oligonucleotide
uuucauguaaccaagaguauuccauuu

SEQ ID NO: 2106 - RNA, 27 nt, Artificial Sequence
  Synthetic oligonucleotide
uucauguaaccaagaguauuccauuuu

SEQ ID NO: 2107 - RNA, 27 nt, Artificial Sequence
  Synthetic oligonucleotide
ucauguaaccaagaguauuccauuuuu

SEQ ID NO: 2108 - RNA, 27 nt, Artificial Sequence
  Synthetic oligonucleotide
cauguaaccaagaguauuccauuuuua

SEQ ID NO: 2109 - RNA, 27 nt, Artificial Sequence
  Synthetic oligonucleotide
auguaaccaagaguauuccauuuuuac

SEQ ID NO: 2110 - RNA, 27 nt, Artificial Sequence
  Synthetic oligonucleotide
uguaaccaagaguauuccauuuuuacu

SEQ ID NO: 2111 - RNA, 27 nt, Artificial Sequence
  Synthetic oligonucleotide
guaaccaagaguauuccauuuuuacua

SEQ ID NO: 2112 - RNA, 27 nt, Artificial Sequence
  Synthetic oligonucleotide
uaaccaagaguauuccauuuuuacuaa

SEQ ID NO: 2113 - RNA, 27 nt, Artificial Sequence
  Synthetic oligonucleotide
aaccaagaguauuccauuuuuacuaaa

SEQ ID NO: 2114 - RNA, 27 nt, Artificial Sequence
  Synthetic oligonucleotide
accaagaguauuccauuuuuacuaaag

SEQ ID NO: 2115 - RNA, 27 nt, Artificial Sequence
  Synthetic oligonucleotide
ccaagaguauuccauuuuuacuaaagc

SEQ ID NO: 2116 - RNA, 27 nt, Artificial Sequence
  Synthetic oligonucleotide
caagaguauuccauuuuuacuaaagca

SEQ ID NO: 2117 - RNA, 27 nt, Artificial Sequence
  Synthetic oligonucleotide
aagaguauuccauuuuuacuaaagcag

SEQ ID NO: 2118 - RNA, 27 nt, Artificial Sequence
  Synthetic oligonucleotide
agaguauuccauuuuuacuaaagcagu

SEQ ID NO: 2119 - RNA, 27 nt, Artificial Sequence
  Synthetic oligonucleotide
gaguauuccauuuuuacuaaagcagug

SEQ ID NO: 2120 - RNA, 27 nt, Artificial Sequence
  Synthetic oligonucleotide
aguauuccauuuuuacuaaagcagugu

SEQ ID NO: 2121 - RNA, 27 nt, Artificial Sequence
  Synthetic oligonucleotide
guauuccauuuuuacuaaagcaguguu

SEQ ID NO: 2122 - RNA, 27 nt, Artificial Sequence
  Synthetic oligonucleotide
uauuccauuuuuacuaaagcaguguuu

SEQ ID NO: 2123 - RNA, 27 nt, Artificial Sequence
  Synthetic oligonucleotide
auuccauuuuuacuaaagcaguguuuu

SEQ ID NO: 2124 - RNA, 27 nt, Artificial Sequence
  Synthetic oligonucleotide
uuccauuuuuacuaaagcaguguuuuc

SEQ ID NO: 2125 - RNA, 27 nt, Artificial Sequence
  Synthetic oligonucleotide
uccauuuuuacuaaagcaguguuuuca

SEQ ID NO: 2126 - RNA, 27 nt, Artificial Sequence
  Synthetic oligonucleotide
ccauuuuuacuaaagcaguguuuucac

SEQ ID NO: 2127 - RNA, 27 nt, Artificial Sequence
  Synthetic oligonucleotide
cauuuuuacuaaagcaguguuuucacc

SEQ ID NO: 2128 - RNA, 27 nt, Artificial Sequence
  Synthetic oligonucleotide
auuuuuacuaaagcaguguuuucaccu

SEQ ID NO: 2129 - RNA, 27 nt, Artificial Sequence
  Synthetic oligonucleotide
uuuuuacuaaagcaguguuuucaccuc

SEQ ID NO: 2130 - RNA, 27 nt, Artificial Sequence
  Synthetic oligonucleotide
uuuuacuaaagcaguguuuucaccuca

SEQ ID NO: 2131 - RNA, 27 nt, Artificial Sequence
  Synthetic oligonucleotide
uuuacuaaagcaguguuuucaccucau

SEQ ID NO: 2132 - RNA, 27 nt, Artificial Sequence
  Synthetic oligonucleotide
uuacuaaagcaguguuuucaccucaua

SEQ ID NO: 2133 - RNA, 27 nt, Artificial Sequence
  Synthetic oligonucleotide
uacuaaagcaguguuuucaccucauau

SEQ ID NO: 2134 - RNA, 27 nt, Artificial Sequence
  Synthetic oligonucleotide
acuaaagcaguguuuucaccucauaug

SEQ ID NO: 2135 - RNA, 27 nt, Artificial Sequence
  Synthetic oligonucleotide
cuaaagcaguguuuucaccucauaugc

SEQ ID NO: 2136 - RNA, 27 nt, Artificial Sequence
  Synthetic oligonucleotide
uaaagcaguguuuucaccucauaugcu

SEQ ID NO: 2137 - RNA, 27 nt, Artificial Sequence
  Synthetic oligonucleotide
aaagcaguguuuucaccucauaugcua

SEQ ID NO: 2138 - RNA, 27 nt, Artificial Sequence
  Synthetic oligonucleotide
aagcaguguuuucaccucauaugcuau

SEQ ID NO: 2139 - RNA, 27 nt, Artificial Sequence
  Synthetic oligonucleotide
agcaguguuuucaccucauaugcuaug

SEQ ID NO: 2140 - RNA, 27 nt, Artificial Sequence
  Synthetic oligonucleotide
gcaguguuuucaccucauaugcuaugu

SEQ ID NO: 2141 - RNA, 27 nt, Artificial Sequence
  Synthetic oligonucleotide
caguguuuucaccucauaugcuauguu

SEQ ID NO: 2142 - RNA, 27 nt, Artificial Sequence
  Synthetic oligonucleotide
aguguuuucaccucauaugcuauguua

SEQ ID NO: 2143 - RNA, 27 nt, Artificial Sequence
  Synthetic oligonucleotide
guguuuucaccucauaugcuauguuag

SEQ ID NO: 2144 - RNA, 27 nt, Artificial Sequence
  Synthetic oligonucleotide
uguuuucaccucauaugcuauguuaga

SEQ ID NO: 2145 - RNA, 27 nt, Artificial Sequence
  Synthetic oligonucleotide
guuuucaccucauaugcuauguuagaa

SEQ ID NO: 2146 - RNA, 27 nt, Artificial Sequence
  Synthetic oligonucleotide
uuuucaccucauaugcuauguuagaag

SEQ ID NO: 2147 - RNA, 27 nt, Artificial Sequence
  Synthetic oligonucleotide
uuucaccucauaugcuauguuagaagu

SEQ ID NO: 2148 - RNA, 27 nt, Artificial Sequence
  Synthetic oligonucleotide
uucaccucauaugcuauguuagaaguc

SEQ ID NO: 2149 - RNA, 27 nt, Artificial Sequence
  Synthetic oligonucleotide
ucaccucauaugcuauguuagaagucc

SEQ ID NO: 2150 - RNA, 27 nt, Artificial Sequence
  Synthetic oligonucleotide
caccucauaugcuauguuagaagucca

SEQ ID NO: 2151 - RNA, 27 nt, Artificial Sequence
  Synthetic oligonucleotide
accucauaugcuauguuagaaguccag

SEQ ID NO: 2152 - RNA, 27 nt, Artificial Sequence
  Synthetic oligonucleotide
ccucauaugcuauguuagaaguccagg

SEQ ID NO: 2153 - RNA, 27 nt, Artificial Sequence
  Synthetic oligonucleotide
cucauaugcuauguuagaaguccaggc

SEQ ID NO: 2154 - RNA, 27 nt, Artificial Sequence
  Synthetic oligonucleotide
ucauaugcuauguuagaaguccaggca

SEQ ID NO: 2155 - RNA, 27 nt, Artificial Sequence
  Synthetic oligonucleotide
cauaugcuauguuagaaguccaggcag

SEQ ID NO: 2156 - RNA, 27 nt, Artificial Sequence
  Synthetic oligonucleotide
auaugcuauguuagaaguccaggcaga

SEQ ID NO: 2157 - RNA, 27 nt, Artificial Sequence
  Synthetic oligonucleotide
ugcuauguuagaaguccaggcagagac

SEQ ID NO: 2158 - RNA, 27 nt, Artificial Sequence
  Synthetic oligonucleotide
cuauguuagaaguccaggcagagacaa

SEQ ID NO: 2159 - RNA, 27 nt, Artificial Sequence
  Synthetic oligonucleotide
uauguuagaaguccaggcagagacaau

SEQ ID NO: 2160 - RNA, 27 nt, Artificial Sequence
  Synthetic oligonucleotide
auguuagaaguccaggcagagacaaua

SEQ ID NO: 2161 - RNA, 27 nt, Artificial Sequence
  Synthetic oligonucleotide
uguuagaaguccaggcagagacaauaa

SEQ ID NO: 2162 - RNA, 27 nt, Artificial Sequence
  Synthetic oligonucleotide
guuagaaguccaggcagagacaauaaa

SEQ ID NO: 2163 - RNA, 27 nt, Artificial Sequence
  Synthetic oligonucleotide
uuagaaguccaggcagagacaauaaaa

SEQ ID NO: 2164 - RNA, 27 nt, Artificial Sequence
  Synthetic oligonucleotide
uagaaguccaggcagagacaauaaaac

SEQ ID NO: 2165 - RNA, 27 nt, Artificial Sequence
  Synthetic oligonucleotide
agaaguccaggcagagacaauaaaaca

SEQ ID NO: 2166 - RNA, 27 nt, Artificial Sequence
  Synthetic oligonucleotide
gaaguccaggcagagacaauaaaacau

SEQ ID NO: 2167 - RNA, 27 nt, Artificial Sequence
  Synthetic oligonucleotide
aaguccaggcagagacaauaaaacauu

SEQ ID NO: 2168 - RNA, 27 nt, Artificial Sequence
  Synthetic oligonucleotide
aguccaggcagagacaauaaaacauuc

SEQ ID NO: 2169 - RNA, 27 nt, Artificial Sequence
  Synthetic oligonucleotide
uccaggcagagacaauaaaacauuccu

SEQ ID NO: 2170 - RNA, 27 nt, Artificial Sequence
  Synthetic oligonucleotide
ccaggcagagacaauaaaacauuccug

SEQ ID NO: 2171 - RNA, 27 nt, Artificial Sequence
  Synthetic oligonucleotide
caggcagagacaauaaaacauuccugu

SEQ ID NO: 2172 - RNA, 27 nt, Artificial Sequence
  Synthetic oligonucleotide
aggcagagacaauaaaacauuccugug

SEQ ID NO: 2173 - RNA, 27 nt, Artificial Sequence
  Synthetic oligonucleotide
ggcagagacaauaaaacauuccuguga

SEQ ID NO: 2174 - RNA, 27 nt, Artificial Sequence
  Synthetic oligonucleotide
gcagagacaauaaaacauuccugugaa

SEQ ID NO: 2175 - RNA, 27 nt, Artificial Sequence
  Synthetic oligonucleotide
cagagacaauaaaacauuccugugaaa

SEQ ID NO: 2176 - RNA, 27 nt, Artificial Sequence
  Synthetic oligonucleotide
agagacaauaaaacauuccugugaaag

SEQ ID NO: 2177 - RNA, 27 nt, Artificial Sequence
  Synthetic oligonucleotide
gagacaauaaaacauuccugugaaagg

SEQ ID NO: 2178 - RNA, 27 nt, Artificial Sequence
  Synthetic oligonucleotide
agacaauaaaacauuccugugaaaggc

SEQ ID NO: 2179 - RNA, 27 nt, Artificial Sequence
  Synthetic oligonucleotide
gacaauaaaacauuccugugaaaggca

SEQ ID NO: 2180 - RNA, 27 nt, Artificial Sequence
  Synthetic oligonucleotide
acaauaaaacauuccugugaaaggcac

SEQ ID NO: 2181 - RNA, 27 nt, Artificial Sequence
  Synthetic oligonucleotide
caauaaaacauuccugugaaaggcacu

SEQ ID NO: 2182 - RNA, 27 nt, Artificial Sequence
  Synthetic oligonucleotide
uaaaacauuccugugaaaggcacuuuu

SEQ ID NO: 2183 - RNA, 27 nt, Artificial Sequence
  Synthetic oligonucleotide
aaaacauuccugugaaaggcacuuuuc

SEQ ID NO: 2184 - RNA, 27 nt, Artificial Sequence
  Synthetic oligonucleotide
aaacauuccugugaaaggcacuuuuca

SEQ ID NO: 2185 - RNA, 27 nt, Artificial Sequence
  Synthetic oligonucleotide
aacauuccugugaaaggcacuuuucau

SEQ ID NO: 2186 - RNA, 27 nt, Artificial Sequence
  Synthetic oligonucleotide
acauuccugugaaaggcacuuuucauu

SEQ ID NO: 2187 - RNA, 27 nt, Artificial Sequence
  Synthetic oligonucleotide
cauuccugugaaaggcacuuuucauuc

SEQ ID NO: 2188 - RNA, 27 nt, Artificial Sequence
  Synthetic oligonucleotide
uuccugugaaaggcacuuuucauucca

SEQ ID NO: 2189 - RNA, 27 nt, Artificial Sequence
  Synthetic oligonucleotide
uccugugaaaggcacuuuucauuccac

SEQ ID NO: 2190 - RNA, 27 nt, Artificial Sequence
  Synthetic oligonucleotide
ccugugaaaggcacuuuucauuccacu

SEQ ID NO: 2191 - RNA, 27 nt, Artificial Sequence
  Synthetic oligonucleotide
cugugaaaggcacuuuucauuccacuu

SEQ ID NO: 2192 - RNA, 27 nt, Artificial Sequence
  Synthetic oligonucleotide
ugugaaaggcacuuuucauuccacuuu

SEQ ID NO: 2193 - RNA, 27 nt, Artificial Sequence
  Synthetic oligonucleotide
gugaaaggcacuuuucauuccacuuua

SEQ ID NO: 2194 - RNA, 27 nt, Artificial Sequence
  Synthetic oligonucleotide
ugaaaggcacuuuucauuccacuuuaa

SEQ ID NO: 2195 - RNA, 27 nt, Artificial Sequence
  Synthetic oligonucleotide
gaaaggcacuuuucauuccacuuuaac

SEQ ID NO: 2196 - RNA, 27 nt, Artificial Sequence
  Synthetic oligonucleotide
aaaggcacuuuucauuccacuuuaacu

SEQ ID NO: 2197 - RNA, 27 nt, Artificial Sequence
  Synthetic oligonucleotide
aaggcacuuuucauuccacuuuaacuu

SEQ ID NO: 2198 - RNA, 27 nt, Artificial Sequence
  Synthetic oligonucleotide
aggcacuuuucauuccacuuuaacuug

SEQ ID NO: 2199 - RNA, 27 nt, Artificial Sequence
  Synthetic oligonucleotide
ggcacuuuucauuccacuuuaacuuga

SEQ ID NO: 2200 - RNA, 27 nt, Artificial Sequence
  Synthetic oligonucleotide
gcacuuuucauuccacuuuaacuugau

SEQ ID NO: 2201 - RNA, 27 nt, Artificial Sequence
  Synthetic oligonucleotide
cacuuuucauuccacuuuaacuugauu

SEQ ID NO: 2202 - RNA, 27 nt, Artificial Sequence
  Synthetic oligonucleotide
acuuuucauuccacuuuaacuugauuu

SEQ ID NO: 2203 - RNA, 27 nt, Artificial Sequence
  Synthetic oligonucleotide
cuuuucauuccacuuuaacuugauuuu

SEQ ID NO: 2204 - RNA, 27 nt, Artificial Sequence
  Synthetic oligonucleotide
uuuucauuccacuuuaacuugauuuuu

SEQ ID NO: 2205 - RNA, 27 nt, Artificial Sequence
  Synthetic oligonucleotide
uuucauuccacuuuaacuugauuuuuu

SEQ ID NO: 2206 - RNA, 27 nt, Artificial Sequence
  Synthetic oligonucleotide
uucauuccacuuuaacuugauuuuuua

SEQ ID NO: 2207 - RNA, 27 nt, Artificial Sequence
  Synthetic oligonucleotide
ucauuccacuuuaacuugauuuuuuaa

SEQ ID NO: 2208 - RNA, 27 nt, Artificial Sequence
  Synthetic oligonucleotide
cauuccacuuuaacuugauuuuuuaaa

SEQ ID NO: 2209 - RNA, 27 nt, Artificial Sequence
  Synthetic oligonucleotide
auuccacuuuaacuugauuuuuuaaau

SEQ ID NO: 2210 - RNA, 27 nt, Artificial Sequence
  Synthetic oligonucleotide
uuccacuuuaacuugauuuuuuaaauu

SEQ ID NO: 2211 - RNA, 27 nt, Artificial Sequence
  Synthetic oligonucleotide
uccacuuuaacuugauuuuuuaaauuc

SEQ ID NO: 2212 - RNA, 27 nt, Artificial Sequence
  Synthetic oligonucleotide
ccacuuuaacuugauuuuuuaaauucc

SEQ ID NO: 2213 - RNA, 27 nt, Artificial Sequence
  Synthetic oligonucleotide
cacuuuaacuugauuuuuuaaauuccc

SEQ ID NO: 2214 - RNA, 27 nt, Artificial Sequence
  Synthetic oligonucleotide
acuuuaacuugauuuuuuaaauucccu

SEQ ID NO: 2215 - RNA, 27 nt, Artificial Sequence
  Synthetic oligonucleotide
cuuuaacuugauuuuuuaaauucccuu

SEQ ID NO: 2216 - RNA, 27 nt, Artificial Sequence
  Synthetic oligonucleotide
uuuaacuugauuuuuuaaauucccuua

SEQ ID NO: 2217 - RNA, 27 nt, Artificial Sequence
  Synthetic oligonucleotide
uuaacuugauuuuuuaaauucccuuau

SEQ ID NO: 2218 - RNA, 27 nt, Artificial Sequence
  Synthetic oligonucleotide
uaacuugauuuuuuaaauucccuuauu

SEQ ID NO: 2219 - RNA, 27 nt, Artificial Sequence
  Synthetic oligonucleotide
aacuugauuuuuuaaauucccuuauug

SEQ ID NO: 2220 - RNA, 27 nt, Artificial Sequence
  Synthetic oligonucleotide
acuugauuuuuuaaauucccuuauugu

SEQ ID NO: 2221 - RNA, 27 nt, Artificial Sequence
  Synthetic oligonucleotide
cuugauuuuuuaaauucccuuauuguc

SEQ ID NO: 2222 - RNA, 27 nt, Artificial Sequence
  Synthetic oligonucleotide
uugauuuuuuaaauucccuuauugucc

SEQ ID NO: 2223 - RNA, 27 nt, Artificial Sequence
  Synthetic oligonucleotide
ugauuuuuuaaauucccuuauuguccc

SEQ ID NO: 2224 - RNA, 27 nt, Artificial Sequence
  Synthetic oligonucleotide
auuuuuuaaauucccuuauugucccuu

SEQ ID NO: 2225 - RNA, 27 nt, Artificial Sequence
  Synthetic oligonucleotide
uuaaauucccuuauugucccuuccaaa

SEQ ID NO: 2226 - RNA, 27 nt, Artificial Sequence
  Synthetic oligonucleotide
uaaauucccuuauugucccuuccaaaa

SEQ ID NO: 2227 - RNA, 27 nt, Artificial Sequence
  Synthetic oligonucleotide
auucccuuauugucccuuccaaaaaaa

SEQ ID NO: 2228 - RNA, 27 nt, Artificial Sequence
  Synthetic oligonucleotide
aaaaaaagagaaucaaaauuuuacaaa

SEQ ID NO: 2229 - RNA, 27 nt, Artificial Sequence
  Synthetic oligonucleotide
aaaaaagagaaucaaaauuuuacaaag

SEQ ID NO: 2230 - RNA, 27 nt, Artificial Sequence
  Synthetic oligonucleotide
aaaaagagaaucaaaauuuuacaaaga

SEQ ID NO: 2231 - RNA, 27 nt, Artificial Sequence
  Synthetic oligonucleotide
aaaagagaaucaaaauuuuacaaagaa

SEQ ID NO: 2232 - RNA, 27 nt, Artificial Sequence
  Synthetic oligonucleotide
aaagagaaucaaaauuuuacaaagaau

SEQ ID NO: 2233 - RNA, 27 nt, Artificial Sequence
  Synthetic oligonucleotide
aagagaaucaaaauuuuacaaagaauc

SEQ ID NO: 2234 - RNA, 27 nt, Artificial Sequence
  Synthetic oligonucleotide
agagaaucaaaauuuuacaaagaauca

SEQ ID NO: 2235 - RNA, 27 nt, Artificial Sequence
  Synthetic oligonucleotide
gagaaucaaaauuuuacaaagaaucaa

SEQ ID NO: 2236 - RNA, 27 nt, Artificial Sequence
  Synthetic oligonucleotide
agaaucaaaauuuuacaaagaaucaaa

SEQ ID NO: 2237 - RNA, 27 nt, Artificial Sequence
  Synthetic oligonucleotide
gaaucaaaauuuuacaaagaaucaaag

SEQ ID NO: 2238 - RNA, 27 nt, Artificial Sequence
  Synthetic oligonucleotide
aaucaaaauuuuacaaagaaucaaagg

SEQ ID NO: 2239 - RNA, 27 nt, Artificial Sequence
  Synthetic oligonucleotide
aucaaaauuuuacaaagaaucaaagga

SEQ ID NO: 2240 - RNA, 27 nt, Artificial Sequence
  Synthetic oligonucleotide
ucaaaauuuuacaaagaaucaaaggaa

SEQ ID NO: 2241 - RNA, 27 nt, Artificial Sequence
  Synthetic oligonucleotide
caaaauuuuacaaagaaucaaaggaau

SEQ ID NO: 2242 - RNA, 27 nt, Artificial Sequence
  Synthetic oligonucleotide
aaaauuuuacaaagaaucaaaggaauu

SEQ ID NO: 2243 - RNA, 27 nt, Artificial Sequence
  Synthetic oligonucleotide
aauuuuacaaagaaucaaaggaauucu

SEQ ID NO: 2244 - RNA, 27 nt, Artificial Sequence
  Synthetic oligonucleotide
auuuuacaaagaaucaaaggaauucua

SEQ ID NO: 2245 - RNA, 27 nt, Artificial Sequence
  Synthetic oligonucleotide
uuuuacaaagaaucaaaggaauucuag

SEQ ID NO: 2246 - RNA, 27 nt, Artificial Sequence
  Synthetic oligonucleotide
uuuacaaagaaucaaaggaauucuaga

SEQ ID NO: 2247 - RNA, 27 nt, Artificial Sequence
  Synthetic oligonucleotide
uuacaaagaaucaaaggaauucuagaa

SEQ ID NO: 2248 - RNA, 27 nt, Artificial Sequence
  Synthetic oligonucleotide
uacaaagaaucaaaggaauucuagaaa

SEQ ID NO: 2249 - RNA, 27 nt, Artificial Sequence
  Synthetic oligonucleotide
acaaagaaucaaaggaauucuagaaag

SEQ ID NO: 2250 - RNA, 27 nt, Artificial Sequence
  Synthetic oligonucleotide
caaagaaucaaaggaauucuagaaagu

SEQ ID NO: 2251 - RNA, 27 nt, Artificial Sequence
  Synthetic oligonucleotide
aaagaaucaaaggaauucuagaaagua

SEQ ID NO: 2252 - RNA, 27 nt, Artificial Sequence
  Synthetic oligonucleotide
aagaaucaaaggaauucuagaaaguau

SEQ ID NO: 2253 - RNA, 27 nt, Artificial Sequence
  Synthetic oligonucleotide
agaaucaaaggaauucuagaaaguauc

SEQ ID NO: 2254 - RNA, 27 nt, Artificial Sequence
  Synthetic oligonucleotide
gaaucaaaggaauucuagaaaguaucu

SEQ ID NO: 2255 - RNA, 27 nt, Artificial Sequence
  Synthetic oligonucleotide
aaucaaaggaauucuagaaaguaucug

SEQ ID NO: 2256 - RNA, 27 nt, Artificial Sequence
  Synthetic oligonucleotide
aucaaaggaauucuagaaaguaucugg

SEQ ID NO: 2257 - RNA, 27 nt, Artificial Sequence
  Synthetic oligonucleotide
ucaaaggaauucuagaaaguaucuggg

SEQ ID NO: 2258 - RNA, 27 nt, Artificial Sequence
  Synthetic oligonucleotide
cuaggagagauccaaauuuccauuguc

SEQ ID NO: 2259 - RNA, 27 nt, Artificial Sequence
  Synthetic oligonucleotide
uaggagagauccaaauuuccauugucu

SEQ ID NO: 2260 - RNA, 27 nt, Artificial Sequence
  Synthetic oligonucleotide
gagagauccaaauuuccauugucuugc

SEQ ID NO: 2261 - RNA, 27 nt, Artificial Sequence
  Synthetic oligonucleotide
agagauccaaauuuccauugucuugca

SEQ ID NO: 2262 - RNA, 27 nt, Artificial Sequence
  Synthetic oligonucleotide
gagauccaaauuuccauugucuugcaa

SEQ ID NO: 2263 - RNA, 27 nt, Artificial Sequence
  Synthetic oligonucleotide
agauccaaauuuccauugucuugcaag

SEQ ID NO: 2264 - RNA, 27 nt, Artificial Sequence
  Synthetic oligonucleotide
gauccaaauuuccauugucuugcaagc

SEQ ID NO: 2265 - RNA, 27 nt, Artificial Sequence
  Synthetic oligonucleotide
auccaaauuuccauugucuugcaagca

SEQ ID NO: 2266 - RNA, 27 nt, Artificial Sequence
  Synthetic oligonucleotide
uccaaauuuccauugucuugcaagcaa

SEQ ID NO: 2267 - RNA, 27 nt, Artificial Sequence
  Synthetic oligonucleotide
ccaaauuuccauugucuugcaagcaaa

SEQ ID NO: 2268 - RNA, 27 nt, Artificial Sequence
  Synthetic oligonucleotide
caaauuuccauugucuugcaagcaaag

SEQ ID NO: 2269 - RNA, 27 nt, Artificial Sequence
  Synthetic oligonucleotide
aaauuuccauugucuugcaagcaaagc

SEQ ID NO: 2270 - RNA, 27 nt, Artificial Sequence
  Synthetic oligonucleotide
aauuuccauugucuugcaagcaaagca

SEQ ID NO: 2271 - RNA, 27 nt, Artificial Sequence
  Synthetic oligonucleotide
auuuccauugucuugcaagcaaagcac

SEQ ID NO: 2272 - RNA, 27 nt, Artificial Sequence
  Synthetic oligonucleotide
uuuccauugucuugcaagcaaagcacg

SEQ ID NO: 2273 - RNA, 27 nt, Artificial Sequence
  Synthetic oligonucleotide
uuccauugucuugcaagcaaagcacgu

SEQ ID NO: 2274 - RNA, 27 nt, Artificial Sequence
  Synthetic oligonucleotide
uccauugucuugcaagcaaagcacgua

SEQ ID NO: 2275 - RNA, 27 nt, Artificial Sequence
  Synthetic oligonucleotide
ccauugucuugcaagcaaagcacguau

SEQ ID NO: 2276 - RNA, 27 nt, Artificial Sequence
  Synthetic oligonucleotide
cauugucuugcaagcaaagcacguauu

SEQ ID NO: 2277 - RNA, 27 nt, Artificial Sequence
  Synthetic oligonucleotide
auugucuugcaagcaaagcacguauua

SEQ ID NO: 2278 - RNA, 27 nt, Artificial Sequence
  Synthetic oligonucleotide
uugucuugcaagcaaagcacguauuaa

SEQ ID NO: 2279 - RNA, 27 nt, Artificial Sequence
  Synthetic oligonucleotide
ugucuugcaagcaaagcacguauuaaa

SEQ ID NO: 2280 - RNA, 27 nt, Artificial Sequence
  Synthetic oligonucleotide
gucuugcaagcaaagcacguauuaaau

SEQ ID NO: 2281 - RNA, 27 nt, Artificial Sequence
  Synthetic oligonucleotide
ucuugcaagcaaagcacguauuaaaua

SEQ ID NO: 2282 - RNA, 27 nt, Artificial Sequence
  Synthetic oligonucleotide
cuugcaagcaaagcacguauuaaauau

SEQ ID NO: 2283 - RNA, 27 nt, Artificial Sequence
  Synthetic oligonucleotide
uugcaagcaaagcacguauuaaauaug

SEQ ID NO: 2284 - RNA, 27 nt, Artificial Sequence
  Synthetic oligonucleotide
ugcaagcaaagcacguauuaaauauga

SEQ ID NO: 2285 - RNA, 27 nt, Artificial Sequence
  Synthetic oligonucleotide
gcaagcaaagcacguauuaaauaugau

SEQ ID NO: 2286 - RNA, 27 nt, Artificial Sequence
  Synthetic oligonucleotide
caagcaaagcacguauuaaauaugauc

SEQ ID NO: 2287 - RNA, 27 nt, Artificial Sequence
  Synthetic oligonucleotide
aagcaaagcacguauuaaauaugaucu

SEQ ID NO: 2288 - RNA, 27 nt, Artificial Sequence
  Synthetic oligonucleotide
agcaaagcacguauuaaauaugaucug

SEQ ID NO: 2289 - RNA, 27 nt, Artificial Sequence
  Synthetic oligonucleotide
gcaaagcacguauuaaauaugaucugc

SEQ ID NO: 2290 - RNA, 27 nt, Artificial Sequence
  Synthetic oligonucleotide
caaagcacguauuaaauaugaucugca

SEQ ID NO: 2291 - RNA, 27 nt, Artificial Sequence
  Synthetic oligonucleotide
aaagcacguauuaaauaugaucugcag

SEQ ID NO: 2292 - RNA, 27 nt, Artificial Sequence
  Synthetic oligonucleotide
aagcacguauuaaauaugaucugcagc

SEQ ID NO: 2293 - RNA, 27 nt, Artificial Sequence
  Synthetic oligonucleotide
agcacguauuaaauaugaucugcagcc

SEQ ID NO: 2294 - RNA, 27 nt, Artificial Sequence
  Synthetic oligonucleotide
cacguauuaaauaugaucugcagccau

SEQ ID NO: 2295 - RNA, 27 nt, Artificial Sequence
  Synthetic oligonucleotide
acguauuaaauaugaucugcagccauu

SEQ ID NO: 2296 - RNA, 27 nt, Artificial Sequence
  Synthetic oligonucleotide
guauuaaauaugaucugcagccauuaa

SEQ ID NO: 2297 - RNA, 27 nt, Artificial Sequence
  Synthetic oligonucleotide
uauuaaauaugaucugcagccauuaaa

SEQ ID NO: 2298 - RNA, 27 nt, Artificial Sequence
  Synthetic oligonucleotide
auuaaauaugaucugcagccauuaaaa

SEQ ID NO: 2299 - RNA, 27 nt, Artificial Sequence
  Synthetic oligonucleotide
uuaaauaugaucugcagccauuaaaaa

SEQ ID NO: 2300 - RNA, 27 nt, Artificial Sequence
  Synthetic oligonucleotide
uaaauaugaucugcagccauuaaaaag

SEQ ID NO: 2301 - RNA, 27 nt, Artificial Sequence
  Synthetic oligonucleotide
aaauaugaucugcagccauuaaaaaga

SEQ ID NO: 2302 - RNA, 27 nt, Artificial Sequence
  Synthetic oligonucleotide
aauaugaucugcagccauuaaaaagac

SEQ ID NO: 2303 - RNA, 27 nt, Artificial Sequence
  Synthetic oligonucleotide
auaugaucugcagccauuaaaaagaca

SEQ ID NO: 2304 - RNA, 27 nt, Artificial Sequence
  Synthetic oligonucleotide
uaugaucugcagccauuaaaaagacac

SEQ ID NO: 2305 - RNA, 19 nt, Artificial Sequence
  Synthetic oligonucleotide
ugacuaagucaauaaucag

SEQ ID NO: 2306 - RNA, 19 nt, Artificial Sequence
  Synthetic oligonucleotide
gacuaagucaauaaucaga

SEQ ID NO: 2307 - RNA, 19 nt, Artificial Sequence
  Synthetic oligonucleotide
acuaagucaauaaucagaa

SEQ ID NO: 2308 - RNA, 19 nt, Artificial Sequence
  Synthetic oligonucleotide
cuaagucaauaaucagaau

SEQ ID NO: 2309 - RNA, 19 nt, Artificial Sequence
  Synthetic oligonucleotide
uaagucaauaaucagaauc

SEQ ID NO: 2310 - RNA, 19 nt, Artificial Sequence
  Synthetic oligonucleotide
aagucaauaaucagaauca

SEQ ID NO: 2311 - RNA, 19 nt, Artificial Sequence
  Synthetic oligonucleotide
agucaauaaucagaaucag

SEQ ID NO: 2312 - RNA, 19 nt, Artificial Sequence
  Synthetic oligonucleotide
gucaauaaucagaaucagc

SEQ ID NO: 2313 - RNA, 19 nt, Artificial Sequence
  Synthetic oligonucleotide
ucaauaaucagaaucagca

SEQ ID NO: 2314 - RNA, 19 nt, Artificial Sequence
  Synthetic oligonucleotide
caauaaucagaaucagcag

SEQ ID NO: 2315 - RNA, 19 nt, Artificial Sequence
  Synthetic oligonucleotide
aauaaucagaaucagcagg

SEQ ID NO: 2316 - RNA, 19 nt, Artificial Sequence
  Synthetic oligonucleotide
auaaucagaaucagcaggu

SEQ ID NO: 2317 - RNA, 19 nt, Artificial Sequence
  Synthetic oligonucleotide
uaaucagaaucagcagguu

SEQ ID NO: 2318 - RNA, 19 nt, Artificial Sequence
  Synthetic oligonucleotide
aaucagaaucagcagguuu

SEQ ID NO: 2319 - RNA, 19 nt, Artificial Sequence
  Synthetic oligonucleotide
aucagaaucagcagguuug

SEQ ID NO: 2320 - RNA, 19 nt, Artificial Sequence
  Synthetic oligonucleotide
cagaaucagcagguuugca

SEQ ID NO: 2321 - RNA, 19 nt, Artificial Sequence
  Synthetic oligonucleotide
agaaucagcagguuugcag

SEQ ID NO: 2322 - RNA, 19 nt, Artificial Sequence
  Synthetic oligonucleotide
aaucagcagguuugcaguc

SEQ ID NO: 2323 - RNA, 19 nt, Artificial Sequence
  Synthetic oligonucleotide
aucagcagguuugcaguca

SEQ ID NO: 2324 - RNA, 19 nt, Artificial Sequence
  Synthetic oligonucleotide
gcagucagauuggcaggga

SEQ ID NO: 2325 - RNA, 19 nt, Artificial Sequence
  Synthetic oligonucleotide
gccuagcucaggagaagug

SEQ ID NO: 2326 - RNA, 19 nt, Artificial Sequence
  Synthetic oligonucleotide
uagcucaggagaagugagu

SEQ ID NO: 2327 - RNA, 19 nt, Artificial Sequence
  Synthetic oligonucleotide
agcucaggagaagugagua

SEQ ID NO: 2328 - RNA, 19 nt, Artificial Sequence
  Synthetic oligonucleotide
gcucaggagaagugaguau

SEQ ID NO: 2329 - RNA, 19 nt, Artificial Sequence
  Synthetic oligonucleotide
cucaggagaagugaguaua

SEQ ID NO: 2330 - RNA, 19 nt, Artificial Sequence
  Synthetic oligonucleotide
caggagaagugaguauaaa

SEQ ID NO: 2331 - RNA, 19 nt, Artificial Sequence
  Synthetic oligonucleotide
gcagccaucacagaagucc

SEQ ID NO: 2332 - RNA, 19 nt, Artificial Sequence
  Synthetic oligonucleotide
cagccaucacagaagucca

SEQ ID NO: 2333 - RNA, 19 nt, Artificial Sequence
  Synthetic oligonucleotide
agccaucacagaaguccac

SEQ ID NO: 2334 - RNA, 19 nt, Artificial Sequence
  Synthetic oligonucleotide
gccaucacagaaguccacu

SEQ ID NO: 2335 - RNA, 19 nt, Artificial Sequence
  Synthetic oligonucleotide
ccaucacagaaguccacuc

SEQ ID NO: 2336 - RNA, 19 nt, Artificial Sequence
  Synthetic oligonucleotide
caucacagaaguccacuca

SEQ ID NO: 2337 - RNA, 19 nt, Artificial Sequence
  Synthetic oligonucleotide
aucacagaaguccacucau

SEQ ID NO: 2338 - RNA, 19 nt, Artificial Sequence
  Synthetic oligonucleotide
cacagaaguccacucauuc

SEQ ID NO: 2339 - RNA, 19 nt, Artificial Sequence
  Synthetic oligonucleotide
acagaaguccacucauucu

SEQ ID NO: 2340 - RNA, 19 nt, Artificial Sequence
  Synthetic oligonucleotide
uucuuggcaggauggcuuc

SEQ ID NO: 2341 - RNA, 19 nt, Artificial Sequence
  Synthetic oligonucleotide
ucuuggcaggauggcuucu

SEQ ID NO: 2342 - RNA, 19 nt, Artificial Sequence
  Synthetic oligonucleotide
cuuggcaggauggcuucuc

SEQ ID NO: 2343 - RNA, 19 nt, Artificial Sequence
  Synthetic oligonucleotide
uuggcaggauggcuucuca

SEQ ID NO: 2344 - RNA, 19 nt, Artificial Sequence
  Synthetic oligonucleotide
uggcaggauggcuucucau

SEQ ID NO: 2345 - RNA, 19 nt, Artificial Sequence
  Synthetic oligonucleotide
ggcaggauggcuucucauc

SEQ ID NO: 2346 - RNA, 19 nt, Artificial Sequence
  Synthetic oligonucleotide
gcaggauggcuucucaucg

SEQ ID NO: 2347 - RNA, 19 nt, Artificial Sequence
  Synthetic oligonucleotide
caggauggcuucucaucgu

SEQ ID NO: 2348 - RNA, 19 nt, Artificial Sequence
  Synthetic oligonucleotide
aggauggcuucucaucguc

SEQ ID NO: 2349 - RNA, 19 nt, Artificial Sequence
  Synthetic oligonucleotide
ggauggcuucucaucgucu

SEQ ID NO: 2350 - RNA, 19 nt, Artificial Sequence
  Synthetic oligonucleotide
gauggcuucucaucgucug

SEQ ID NO: 2351 - RNA, 19 nt, Artificial Sequence
  Synthetic oligonucleotide
auggcuucucaucgucugc

SEQ ID NO: 2352 - RNA, 19 nt, Artificial Sequence
  Synthetic oligonucleotide
uggcuucucaucgucugcu

SEQ ID NO: 2353 - RNA, 19 nt, Artificial Sequence
  Synthetic oligonucleotide
ggcuucucaucgucugcuc

SEQ ID NO: 2354 - RNA, 19 nt, Artificial Sequence
  Synthetic oligonucleotide
gcuucucaucgucugcucc

SEQ ID NO: 2355 - RNA, 19 nt, Artificial Sequence
  Synthetic oligonucleotide
cuucucaucgucugcuccu

SEQ ID NO: 2356 - RNA, 19 nt, Artificial Sequence
  Synthetic oligonucleotide
ucugccuugcuggacuggu

SEQ ID NO: 2357 - RNA, 19 nt, Artificial Sequence
  Synthetic oligonucleotide
cugccuugcuggacuggua

SEQ ID NO: 2358 - RNA, 19 nt, Artificial Sequence
  Synthetic oligonucleotide
ccggugaauccaagugucc

SEQ ID NO: 2359 - RNA, 19 nt, Artificial Sequence
  Synthetic oligonucleotide
ugaauccaaguguccucug

SEQ ID NO: 2360 - RNA, 19 nt, Artificial Sequence
  Synthetic oligonucleotide
gaauccaaguguccucuga

SEQ ID NO: 2361 - RNA, 19 nt, Artificial Sequence
  Synthetic oligonucleotide
aauccaaguguccucugau

SEQ ID NO: 2362 - RNA, 19 nt, Artificial Sequence
  Synthetic oligonucleotide
auccaaguguccucugaug

SEQ ID NO: 2363 - RNA, 19 nt, Artificial Sequence
  Synthetic oligonucleotide
uccaaguguccucugaugg

SEQ ID NO: 2364 - RNA, 19 nt, Artificial Sequence
  Synthetic oligonucleotide
ccaaguguccucugauggu

SEQ ID NO: 2365 - RNA, 19 nt, Artificial Sequence
  Synthetic oligonucleotide
caaguguccucugaugguc

SEQ ID NO: 2366 - RNA, 19 nt, Artificial Sequence
  Synthetic oligonucleotide
aaguguccucugaugguca

SEQ ID NO: 2367 - RNA, 19 nt, Artificial Sequence
  Synthetic oligonucleotide
aguguccucugauggucaa

SEQ ID NO: 2368 - RNA, 19 nt, Artificial Sequence
  Synthetic oligonucleotide
guguccucugauggucaaa

SEQ ID NO: 2369 - RNA, 19 nt, Artificial Sequence
  Synthetic oligonucleotide
uguccucugauggucaaag

SEQ ID NO: 2370 - RNA, 19 nt, Artificial Sequence
  Synthetic oligonucleotide
guccucugauggucaaagu

SEQ ID NO: 2371 - RNA, 19 nt, Artificial Sequence
  Synthetic oligonucleotide
uccucugauggucaaaguu

SEQ ID NO: 2372 - RNA, 19 nt, Artificial Sequence
  Synthetic oligonucleotide
ccucugauggucaaaguuc

SEQ ID NO: 2373 - RNA, 19 nt, Artificial Sequence
  Synthetic oligonucleotide
cucugauggucaaaguucu

SEQ ID NO: 2374 - RNA, 19 nt, Artificial Sequence
  Synthetic oligonucleotide
ucugauggucaaaguucua

SEQ ID NO: 2375 - RNA, 19 nt, Artificial Sequence
  Synthetic oligonucleotide
cugauggucaaaguucuag

SEQ ID NO: 2376 - RNA, 19 nt, Artificial Sequence
  Synthetic oligonucleotide
ugauggucaaaguucuaga

SEQ ID NO: 2377 - RNA, 19 nt, Artificial Sequence
  Synthetic oligonucleotide
gauggucaaaguucuagau

SEQ ID NO: 2378 - RNA, 19 nt, Artificial Sequence
  Synthetic oligonucleotide
auggucaaaguucuagaug

SEQ ID NO: 2379 - RNA, 19 nt, Artificial Sequence
  Synthetic oligonucleotide
uggucaaaguucuagaugc

SEQ ID NO: 2380 - RNA, 19 nt, Artificial Sequence
  Synthetic oligonucleotide
gccauuugccucugggaaa

SEQ ID NO: 2381 - RNA, 19 nt, Artificial Sequence
  Synthetic oligonucleotide
ccauuugccucugggaaaa

SEQ ID NO: 2382 - RNA, 19 nt, Artificial Sequence
  Synthetic oligonucleotide
cauuugccucugggaaaac

SEQ ID NO: 2383 - RNA, 19 nt, Artificial Sequence
  Synthetic oligonucleotide
auuugccucugggaaaacc

SEQ ID NO: 2384 - RNA, 19 nt, Artificial Sequence
  Synthetic oligonucleotide
uuugccucugggaaaacca

SEQ ID NO: 2385 - RNA, 19 nt, Artificial Sequence
  Synthetic oligonucleotide
uugccucugggaaaaccag

SEQ ID NO: 2386 - RNA, 19 nt, Artificial Sequence
  Synthetic oligonucleotide
ugccucugggaaaaccagu

SEQ ID NO: 2387 - RNA, 19 nt, Artificial Sequence
  Synthetic oligonucleotide
gccucugggaaaaccagug

SEQ ID NO: 2388 - RNA, 19 nt, Artificial Sequence
  Synthetic oligonucleotide
ccucugggaaaaccaguga

SEQ ID NO: 2389 - RNA, 19 nt, Artificial Sequence
  Synthetic oligonucleotide
cucugggaaaaccagugag

SEQ ID NO: 2390 - RNA, 19 nt, Artificial Sequence
  Synthetic oligonucleotide
ucugggaaaaccagugagu

SEQ ID NO: 2391 - RNA, 19 nt, Artificial Sequence
  Synthetic oligonucleotide
cugggaaaaccagugaguc

SEQ ID NO: 2392 - RNA, 19 nt, Artificial Sequence
  Synthetic oligonucleotide
ugggaaaaccagugagucu

SEQ ID NO: 2393 - RNA, 19 nt, Artificial Sequence
  Synthetic oligonucleotide
gggaaaaccagugagucug

SEQ ID NO: 2394 - RNA, 19 nt, Artificial Sequence
  Synthetic oligonucleotide
ggaaaaccagugagucugg

SEQ ID NO: 2395 - RNA, 19 nt, Artificial Sequence
  Synthetic oligonucleotide
gaaaaccagugagucugga

SEQ ID NO: 2396 - RNA, 19 nt, Artificial Sequence
  Synthetic oligonucleotide
agcugcaugggcucacaac

SEQ ID NO: 2397 - RNA, 19 nt, Artificial Sequence
  Synthetic oligonucleotide
gcugcaugggcucacaacu

SEQ ID NO: 2398 - RNA, 19 nt, Artificial Sequence
  Synthetic oligonucleotide
cugcaugggcucacaacug

SEQ ID NO: 2399 - RNA, 19 nt, Artificial Sequence
  Synthetic oligonucleotide
ugcaugggcucacaacuga

SEQ ID NO: 2400 - RNA, 19 nt, Artificial Sequence
  Synthetic oligonucleotide
gcaugggcucacaacugag

SEQ ID NO: 2401 - RNA, 19 nt, Artificial Sequence
  Synthetic oligonucleotide
caugggcucacaacugagg

SEQ ID NO: 2402 - RNA, 19 nt, Artificial Sequence
  Synthetic oligonucleotide
augggcucacaacugagga

SEQ ID NO: 2403 - RNA, 19 nt, Artificial Sequence
  Synthetic oligonucleotide
ugggcucacaacugaggag

SEQ ID NO: 2404 - RNA, 19 nt, Artificial Sequence
  Synthetic oligonucleotide
gggcucacaacugaggagg

SEQ ID NO: 2405 - RNA, 19 nt, Artificial Sequence
  Synthetic oligonucleotide
ggcucacaacugaggagga

SEQ ID NO: 2406 - RNA, 19 nt, Artificial Sequence
  Synthetic oligonucleotide
gcucacaacugaggaggaa

SEQ ID NO: 2407 - RNA, 19 nt, Artificial Sequence
  Synthetic oligonucleotide
cucacaacugaggaggaau

SEQ ID NO: 2408 - RNA, 19 nt, Artificial Sequence
  Synthetic oligonucleotide
ucacaacugaggaggaauu

SEQ ID NO: 2409 - RNA, 19 nt, Artificial Sequence
  Synthetic oligonucleotide
cacaacugaggaggaauuu

SEQ ID NO: 2410 - RNA, 19 nt, Artificial Sequence
  Synthetic oligonucleotide
acaacugaggaggaauuug

SEQ ID NO: 2411 - RNA, 19 nt, Artificial Sequence
  Synthetic oligonucleotide
caacugaggaggaauuugu

SEQ ID NO: 2412 - RNA, 19 nt, Artificial Sequence
  Synthetic oligonucleotide
acugaggaggaauuuguag

SEQ ID NO: 2413 - RNA, 19 nt, Artificial Sequence
  Synthetic oligonucleotide
cugaggaggaauuuguaga

SEQ ID NO: 2414 - RNA, 19 nt, Artificial Sequence
  Synthetic oligonucleotide
ugaggaggaauuuguagaa

SEQ ID NO: 2415 - RNA, 19 nt, Artificial Sequence
  Synthetic oligonucleotide
gaggaggaauuuguagaag

SEQ ID NO: 2416 - RNA, 19 nt, Artificial Sequence
  Synthetic oligonucleotide
aggaggaauuuguagaagg

SEQ ID NO: 2417 - RNA, 19 nt, Artificial Sequence
  Synthetic oligonucleotide
ggaggaauuuguagaaggg

SEQ ID NO: 2418 - RNA, 19 nt, Artificial Sequence
  Synthetic oligonucleotide
gaggaauuuguagaaggga

SEQ ID NO: 2419 - RNA, 19 nt, Artificial Sequence
  Synthetic oligonucleotide
aggaauuuguagaagggau

SEQ ID NO: 2420 - RNA, 19 nt, Artificial Sequence
  Synthetic oligonucleotide
ggaauuuguagaagggaua

SEQ ID NO: 2421 - RNA, 19 nt, Artificial Sequence
  Synthetic oligonucleotide
gaauuuguagaagggauau

SEQ ID NO: 2422 - RNA, 19 nt, Artificial Sequence
  Synthetic oligonucleotide
aauuuguagaagggauaua

SEQ ID NO: 2423 - RNA, 19 nt, Artificial Sequence
  Synthetic oligonucleotide
auuuguagaagggauauac

SEQ ID NO: 2424 - RNA, 19 nt, Artificial Sequence
  Synthetic oligonucleotide
uuuguagaagggauauaca

SEQ ID NO: 2425 - RNA, 19 nt, Artificial Sequence
  Synthetic oligonucleotide
uuguagaagggauauacaa

SEQ ID NO: 2426 - RNA, 19 nt, Artificial Sequence
  Synthetic oligonucleotide
uguagaagggauauacaaa

SEQ ID NO: 2427 - RNA, 19 nt, Artificial Sequence
  Synthetic oligonucleotide
guagaagggauauacaaag

SEQ ID NO: 2428 - RNA, 19 nt, Artificial Sequence
  Synthetic oligonucleotide
uagaagggauauacaaagu

SEQ ID NO: 2429 - RNA, 19 nt, Artificial Sequence
  Synthetic oligonucleotide
agaagggauauacaaagug

SEQ ID NO: 2430 - RNA, 19 nt, Artificial Sequence
  Synthetic oligonucleotide
gaagggauauacaaagugg

SEQ ID NO: 2431 - RNA, 19 nt, Artificial Sequence
  Synthetic oligonucleotide
aagggauauacaaagugga

SEQ ID NO: 2432 - RNA, 19 nt, Artificial Sequence
  Synthetic oligonucleotide
agggauauacaaaguggaa

SEQ ID NO: 2433 - RNA, 19 nt, Artificial Sequence
  Synthetic oligonucleotide
gggauauacaaaguggaaa

SEQ ID NO: 2434 - RNA, 19 nt, Artificial Sequence
  Synthetic oligonucleotide
ggauauacaaaguggaaau

SEQ ID NO: 2435 - RNA, 19 nt, Artificial Sequence
  Synthetic oligonucleotide
gauauacaaaguggaaaua

SEQ ID NO: 2436 - RNA, 19 nt, Artificial Sequence
  Synthetic oligonucleotide
auauacaaaguggaaauag

SEQ ID NO: 2437 - RNA, 19 nt, Artificial Sequence
  Synthetic oligonucleotide
uauacaaaguggaaauaga

SEQ ID NO: 2438 - RNA, 19 nt, Artificial Sequence
  Synthetic oligonucleotide
auacaaaguggaaauagac

SEQ ID NO: 2439 - RNA, 19 nt, Artificial Sequence
  Synthetic oligonucleotide
uacaaaguggaaauagaca

SEQ ID NO: 2440 - RNA, 19 nt, Artificial Sequence
  Synthetic oligonucleotide
acaaaguggaaauagacac

SEQ ID NO: 2441 - RNA, 19 nt, Artificial Sequence
  Synthetic oligonucleotide
caaaguggaaauagacacc

SEQ ID NO: 2442 - RNA, 19 nt, Artificial Sequence
  Synthetic oligonucleotide
aaaguggaaauagacacca

SEQ ID NO: 2443 - RNA, 19 nt, Artificial Sequence
  Synthetic oligonucleotide
aaguggaaauagacaccaa

SEQ ID NO: 2444 - RNA, 19 nt, Artificial Sequence
  Synthetic oligonucleotide
aguggaaauagacaccaaa

SEQ ID NO: 2445 - RNA, 19 nt, Artificial Sequence
  Synthetic oligonucleotide
guggaaauagacaccaaau

SEQ ID NO: 2446 - RNA, 19 nt, Artificial Sequence
  Synthetic oligonucleotide
uggaaauagacaccaaauc

SEQ ID NO: 2447 - RNA, 19 nt, Artificial Sequence
  Synthetic oligonucleotide
ggaaauagacaccaaaucu

SEQ ID NO: 2448 - RNA, 19 nt, Artificial Sequence
  Synthetic oligonucleotide
gaaauagacaccaaaucuu

SEQ ID NO: 2449 - RNA, 19 nt, Artificial Sequence
  Synthetic oligonucleotide
aaauagacaccaaaucuua

SEQ ID NO: 2450 - RNA, 19 nt, Artificial Sequence
  Synthetic oligonucleotide
aauagacaccaaaucuuac

SEQ ID NO: 2451 - RNA, 19 nt, Artificial Sequence
  Synthetic oligonucleotide
auagacaccaaaucuuacu

SEQ ID NO: 2452 - RNA, 19 nt, Artificial Sequence
  Synthetic oligonucleotide
agacaccaaaucuuacugg

SEQ ID NO: 2453 - RNA, 19 nt, Artificial Sequence
  Synthetic oligonucleotide
gacaccaaaucuuacugga

SEQ ID NO: 2454 - RNA, 19 nt, Artificial Sequence
  Synthetic oligonucleotide
cacuuggcaucuccccauu

SEQ ID NO: 2455 - RNA, 19 nt, Artificial Sequence
  Synthetic oligonucleotide
acuuggcaucuccccauuc

SEQ ID NO: 2456 - RNA, 19 nt, Artificial Sequence
  Synthetic oligonucleotide
cuuggcaucuccccauucc

SEQ ID NO: 2457 - RNA, 19 nt, Artificial Sequence
  Synthetic oligonucleotide
uuggcaucuccccauucca

SEQ ID NO: 2458 - RNA, 19 nt, Artificial Sequence
  Synthetic oligonucleotide
uggcaucuccccauuccau

SEQ ID NO: 2459 - RNA, 19 nt, Artificial Sequence
  Synthetic oligonucleotide
ggcaucuccccauuccaug

SEQ ID NO: 2460 - RNA, 19 nt, Artificial Sequence
  Synthetic oligonucleotide
gcaucuccccauuccauga

SEQ ID NO: 2461 - RNA, 19 nt, Artificial Sequence
  Synthetic oligonucleotide
caucuccccauuccaugag

SEQ ID NO: 2462 - RNA, 19 nt, Artificial Sequence
  Synthetic oligonucleotide
aucuccccauuccaugagc

SEQ ID NO: 2463 - RNA, 19 nt, Artificial Sequence
  Synthetic oligonucleotide
ucuccccauuccaugagca

SEQ ID NO: 2464 - RNA, 19 nt, Artificial Sequence
  Synthetic oligonucleotide
cuccccauuccaugagcau

SEQ ID NO: 2465 - RNA, 19 nt, Artificial Sequence
  Synthetic oligonucleotide
uccccauuccaugagcaug

SEQ ID NO: 2466 - RNA, 19 nt, Artificial Sequence
  Synthetic oligonucleotide
ccccauuccaugagcaugc

SEQ ID NO: 2467 - RNA, 19 nt, Artificial Sequence
  Synthetic oligonucleotide
caugagcaugcagaggugg

SEQ ID NO: 2468 - RNA, 19 nt, Artificial Sequence
  Synthetic oligonucleotide
augagcaugcagagguggu

SEQ ID NO: 2469 - RNA, 19 nt, Artificial Sequence
  Synthetic oligonucleotide
ugagcaugcagagguggua

SEQ ID NO: 2470 - RNA, 19 nt, Artificial Sequence
  Synthetic oligonucleotide
gagcaugcagaggugguau

SEQ ID NO: 2471 - RNA, 19 nt, Artificial Sequence
  Synthetic oligonucleotide
augcagaggugguauucac

SEQ ID NO: 2472 - RNA, 19 nt, Artificial Sequence
  Synthetic oligonucleotide
agaggugguauucacagcc

SEQ ID NO: 2473 - RNA, 19 nt, Artificial Sequence
  Synthetic oligonucleotide
gaggugguauucacagcca

SEQ ID NO: 2474 - RNA, 19 nt, Artificial Sequence
  Synthetic oligonucleotide
gucgucaccaaucccaagg

SEQ ID NO: 2475 - RNA, 19 nt, Artificial Sequence
  Synthetic oligonucleotide
ggacgagggaugggauuuc

SEQ ID NO: 2476 - RNA, 19 nt, Artificial Sequence
  Synthetic oligonucleotide
gacgagggaugggauuuca

SEQ ID NO: 2477 - RNA, 19 nt, Artificial Sequence
  Synthetic oligonucleotide
gagggaugggauuucaugu

SEQ ID NO: 2478 - RNA, 19 nt, Artificial Sequence
  Synthetic oligonucleotide
agggaugggauuucaugua

SEQ ID NO: 2479 - RNA, 19 nt, Artificial Sequence
  Synthetic oligonucleotide
gggaugggauuucauguaa

SEQ ID NO: 2480 - RNA, 19 nt, Artificial Sequence
  Synthetic oligonucleotide
gaugggauuucauguaacc

SEQ ID NO: 2481 - RNA, 19 nt, Artificial Sequence
  Synthetic oligonucleotide
augggauuucauguaacca

SEQ ID NO: 2482 - RNA, 19 nt, Artificial Sequence
  Synthetic oligonucleotide
ugggauuucauguaaccaa

SEQ ID NO: 2483 - RNA, 19 nt, Artificial Sequence
  Synthetic oligonucleotide
gggauuucauguaaccaag

SEQ ID NO: 2484 - RNA, 19 nt, Artificial Sequence
  Synthetic oligonucleotide
ggauuucauguaaccaaga

SEQ ID NO: 2485 - RNA, 19 nt, Artificial Sequence
  Synthetic oligonucleotide
gauuucauguaaccaagag

SEQ ID NO: 2486 - RNA, 19 nt, Artificial Sequence
  Synthetic oligonucleotide
auuucauguaaccaagagu

SEQ ID NO: 2487 - RNA, 19 nt, Artificial Sequence
  Synthetic oligonucleotide
uuucauguaaccaagagua

SEQ ID NO: 2488 - RNA, 19 nt, Artificial Sequence
  Synthetic oligonucleotide
uucauguaaccaagaguau

SEQ ID NO: 2489 - RNA, 19 nt, Artificial Sequence
  Synthetic oligonucleotide
ucauguaaccaagaguauu

SEQ ID NO: 2490 - RNA, 19 nt, Artificial Sequence
  Synthetic oligonucleotide
cauguaaccaagaguauuc

SEQ ID NO: 2491 - RNA, 19 nt, Artificial Sequence
  Synthetic oligonucleotide
auguaaccaagaguauucc

SEQ ID NO: 2492 - RNA, 19 nt, Artificial Sequence
  Synthetic oligonucleotide
uguaaccaagaguauucca

SEQ ID NO: 2493 - RNA, 19 nt, Artificial Sequence
  Synthetic oligonucleotide
guaaccaagaguauuccau

SEQ ID NO: 2494 - RNA, 19 nt, Artificial Sequence
  Synthetic oligonucleotide
uaaccaagaguauuccauu

SEQ ID NO: 2495 - RNA, 19 nt, Artificial Sequence
  Synthetic oligonucleotide
aaccaagaguauuccauuu

SEQ ID NO: 2496 - RNA, 19 nt, Artificial Sequence
  Synthetic oligonucleotide
accaagaguauuccauuuu

SEQ ID NO: 2497 - RNA, 19 nt, Artificial Sequence
  Synthetic oligonucleotide
ccaagaguauuccauuuuu

SEQ ID NO: 2498 - RNA, 19 nt, Artificial Sequence
  Synthetic oligonucleotide
caagaguauuccauuuuua

SEQ ID NO: 2499 - RNA, 19 nt, Artificial Sequence
  Synthetic oligonucleotide
aagaguauuccauuuuuac

SEQ ID NO: 2500 - RNA, 19 nt, Artificial Sequence
  Synthetic oligonucleotide
agaguauuccauuuuuacu

SEQ ID NO: 2501 - RNA, 19 nt, Artificial Sequence
  Synthetic oligonucleotide
gaguauuccauuuuuacua

SEQ ID NO: 2502 - RNA, 19 nt, Artificial Sequence
  Synthetic oligonucleotide
aguauuccauuuuuacuaa

SEQ ID NO: 2503 - RNA, 19 nt, Artificial Sequence
  Synthetic oligonucleotide
guauuccauuuuuacuaaa

SEQ ID NO: 2504 - RNA, 19 nt, Artificial Sequence
  Synthetic oligonucleotide
uauuccauuuuuacuaaag

SEQ ID NO: 2505 - RNA, 19 nt, Artificial Sequence
  Synthetic oligonucleotide
auuccauuuuuacuaaagc

SEQ ID NO: 2506 - RNA, 19 nt, Artificial Sequence
  Synthetic oligonucleotide
uuccauuuuuacuaaagca

SEQ ID NO: 2507 - RNA, 19 nt, Artificial Sequence
  Synthetic oligonucleotide
uccauuuuuacuaaagcag

SEQ ID NO: 2508 - RNA, 19 nt, Artificial Sequence
  Synthetic oligonucleotide
ccauuuuuacuaaagcagu

SEQ ID NO: 2509 - RNA, 19 nt, Artificial Sequence
  Synthetic oligonucleotide
cauuuuuacuaaagcagug

SEQ ID NO: 2510 - RNA, 19 nt, Artificial Sequence
  Synthetic oligonucleotide
auuuuuacuaaagcagugu

SEQ ID NO: 2511 - RNA, 19 nt, Artificial Sequence
  Synthetic oligonucleotide
uuuuuacuaaagcaguguu

SEQ ID NO: 2512 - RNA, 19 nt, Artificial Sequence
  Synthetic oligonucleotide
uuuuacuaaagcaguguuu

SEQ ID NO: 2513 - RNA, 19 nt, Artificial Sequence
  Synthetic oligonucleotide
uuuacuaaagcaguguuuu

SEQ ID NO: 2514 - RNA, 19 nt, Artificial Sequence
  Synthetic oligonucleotide
uuacuaaagcaguguuuuc

SEQ ID NO: 2515 - RNA, 19 nt, Artificial Sequence
  Synthetic oligonucleotide
uacuaaagcaguguuuuca

SEQ ID NO: 2516 - RNA, 19 nt, Artificial Sequence
  Synthetic oligonucleotide
acuaaagcaguguuuucac

SEQ ID NO: 2517 - RNA, 19 nt, Artificial Sequence
  Synthetic oligonucleotide
cuaaagcaguguuuucacc

SEQ ID NO: 2518 - RNA, 19 nt, Artificial Sequence
  Synthetic oligonucleotide
uaaagcaguguuuucaccu

SEQ ID NO: 2519 - RNA, 19 nt, Artificial Sequence
  Synthetic oligonucleotide
aaagcaguguuuucaccuc

SEQ ID NO: 2520 - RNA, 19 nt, Artificial Sequence
  Synthetic oligonucleotide
aagcaguguuuucaccuca

SEQ ID NO: 2521 - RNA, 19 nt, Artificial Sequence
  Synthetic oligonucleotide
agcaguguuuucaccucau

SEQ ID NO: 2522 - RNA, 19 nt, Artificial Sequence
  Synthetic oligonucleotide
gcaguguuuucaccucaua

SEQ ID NO: 2523 - RNA, 19 nt, Artificial Sequence
  Synthetic oligonucleotide
caguguuuucaccucauau

SEQ ID NO: 2524 - RNA, 19 nt, Artificial Sequence
  Synthetic oligonucleotide
aguguuuucaccucauaug

SEQ ID NO: 2525 - RNA, 19 nt, Artificial Sequence
  Synthetic oligonucleotide
guguuuucaccucauaugc

SEQ ID NO: 2526 - RNA, 19 nt, Artificial Sequence
  Synthetic oligonucleotide
uguuuucaccucauaugcu

SEQ ID NO: 2527 - RNA, 19 nt, Artificial Sequence
  Synthetic oligonucleotide
guuuucaccucauaugcua

SEQ ID NO: 2528 - RNA, 19 nt, Artificial Sequence
  Synthetic oligonucleotide
uuuucaccucauaugcuau

SEQ ID NO: 2529 - RNA, 19 nt, Artificial Sequence
  Synthetic oligonucleotide
uuucaccucauaugcuaug

SEQ ID NO: 2530 - RNA, 19 nt, Artificial Sequence
  Synthetic oligonucleotide
uucaccucauaugcuaugu

SEQ ID NO: 2531 - RNA, 19 nt, Artificial Sequence
  Synthetic oligonucleotide
ucaccucauaugcuauguu

SEQ ID NO: 2532 - RNA, 19 nt, Artificial Sequence
  Synthetic oligonucleotide
caccucauaugcuauguua

SEQ ID NO: 2533 - RNA, 19 nt, Artificial Sequence
  Synthetic oligonucleotide
accucauaugcuauguuag

SEQ ID NO: 2534 - RNA, 19 nt, Artificial Sequence
  Synthetic oligonucleotide
ccucauaugcuauguuaga

SEQ ID NO: 2535 - RNA, 19 nt, Artificial Sequence
  Synthetic oligonucleotide
cucauaugcuauguuagaa

SEQ ID NO: 2536 - RNA, 19 nt, Artificial Sequence
  Synthetic oligonucleotide
ucauaugcuauguuagaag

SEQ ID NO: 2537 - RNA, 19 nt, Artificial Sequence
  Synthetic oligonucleotide
cauaugcuauguuagaagu

SEQ ID NO: 2538 - RNA, 19 nt, Artificial Sequence
  Synthetic oligonucleotide
auaugcuauguuagaaguc

SEQ ID NO: 2539 - RNA, 19 nt, Artificial Sequence
  Synthetic oligonucleotide
uaugcuauguuagaagucc

SEQ ID NO: 2540 - RNA, 19 nt, Artificial Sequence
  Synthetic oligonucleotide
augcuauguuagaagucca

SEQ ID NO: 2541 - RNA, 19 nt, Artificial Sequence
  Synthetic oligonucleotide
cuauguuagaaguccaggc

SEQ ID NO: 2542 - RNA, 19 nt, Artificial Sequence
  Synthetic oligonucleotide
auguuagaaguccaggcag

SEQ ID NO: 2543 - RNA, 19 nt, Artificial Sequence
  Synthetic oligonucleotide
uguuagaaguccaggcaga

SEQ ID NO: 2544 - RNA, 19 nt, Artificial Sequence
  Synthetic oligonucleotide
guuagaaguccaggcagag

SEQ ID NO: 2545 - RNA, 19 nt, Artificial Sequence
  Synthetic oligonucleotide
uuagaaguccaggcagaga

SEQ ID NO: 2546 - RNA, 19 nt, Artificial Sequence
  Synthetic oligonucleotide
uagaaguccaggcagagac

SEQ ID NO: 2547 - RNA, 19 nt, Artificial Sequence
  Synthetic oligonucleotide
agaaguccaggcagagaca

SEQ ID NO: 2548 - RNA, 19 nt, Artificial Sequence
  Synthetic oligonucleotide
gaaguccaggcagagacaa

SEQ ID NO: 2549 - RNA, 19 nt, Artificial Sequence
  Synthetic oligonucleotide
aaguccaggcagagacaau

SEQ ID NO: 2550 - RNA, 19 nt, Artificial Sequence
  Synthetic oligonucleotide
aguccaggcagagacaaua

SEQ ID NO: 2551 - RNA, 19 nt, Artificial Sequence
  Synthetic oligonucleotide
guccaggcagagacaauaa

SEQ ID NO: 2552 - RNA, 19 nt, Artificial Sequence
  Synthetic oligonucleotide
uccaggcagagacaauaaa

SEQ ID NO: 2553 - RNA, 19 nt, Artificial Sequence
  Synthetic oligonucleotide
caggcagagacaauaaaac

SEQ ID NO: 2554 - RNA, 19 nt, Artificial Sequence
  Synthetic oligonucleotide
aggcagagacaauaaaaca

SEQ ID NO: 2555 - RNA, 19 nt, Artificial Sequence
  Synthetic oligonucleotide
ggcagagacaauaaaacau

SEQ ID NO: 2556 - RNA, 19 nt, Artificial Sequence
  Synthetic oligonucleotide
gcagagacaauaaaacauu

SEQ ID NO: 2557 - RNA, 19 nt, Artificial Sequence
  Synthetic oligonucleotide
cagagacaauaaaacauuc

SEQ ID NO: 2558 - RNA, 19 nt, Artificial Sequence
  Synthetic oligonucleotide
agagacaauaaaacauucc

SEQ ID NO: 2559 - RNA, 19 nt, Artificial Sequence
  Synthetic oligonucleotide
gagacaauaaaacauuccu

SEQ ID NO: 2560 - RNA, 19 nt, Artificial Sequence
  Synthetic oligonucleotide
agacaauaaaacauuccug

SEQ ID NO: 2561 - RNA, 19 nt, Artificial Sequence
  Synthetic oligonucleotide
gacaauaaaacauuccugu

SEQ ID NO: 2562 - RNA, 19 nt, Artificial Sequence
  Synthetic oligonucleotide
acaauaaaacauuccugug

SEQ ID NO: 2563 - RNA, 19 nt, Artificial Sequence
  Synthetic oligonucleotide
caauaaaacauuccuguga

SEQ ID NO: 2564 - RNA, 19 nt, Artificial Sequence
  Synthetic oligonucleotide
aauaaaacauuccugugaa

SEQ ID NO: 2565 - RNA, 19 nt, Artificial Sequence
  Synthetic oligonucleotide
auaaaacauuccugugaaa

SEQ ID NO: 2566 - RNA, 19 nt, Artificial Sequence
  Synthetic oligonucleotide
aaacauuccugugaaaggc

SEQ ID NO: 2567 - RNA, 19 nt, Artificial Sequence
  Synthetic oligonucleotide
aacauuccugugaaaggca

SEQ ID NO: 2568 - RNA, 19 nt, Artificial Sequence
  Synthetic oligonucleotide
acauuccugugaaaggcac

SEQ ID NO: 2569 - RNA, 19 nt, Artificial Sequence
  Synthetic oligonucleotide
cauuccugugaaaggcacu

SEQ ID NO: 2570 - RNA, 19 nt, Artificial Sequence
  Synthetic oligonucleotide
auuccugugaaaggcacuu

SEQ ID NO: 2571 - RNA, 19 nt, Artificial Sequence
  Synthetic oligonucleotide
uuccugugaaaggcacuuu

SEQ ID NO: 2572 - RNA, 19 nt, Artificial Sequence
  Synthetic oligonucleotide
ccugugaaaggcacuuuuc

SEQ ID NO: 2573 - RNA, 19 nt, Artificial Sequence
  Synthetic oligonucleotide
cugugaaaggcacuuuuca

SEQ ID NO: 2574 - RNA, 19 nt, Artificial Sequence
  Synthetic oligonucleotide
ugugaaaggcacuuuucau

SEQ ID NO: 2575 - RNA, 19 nt, Artificial Sequence
  Synthetic oligonucleotide
gugaaaggcacuuuucauu

SEQ ID NO: 2576 - RNA, 19 nt, Artificial Sequence
  Synthetic oligonucleotide
ugaaaggcacuuuucauuc

SEQ ID NO: 2577 - RNA, 19 nt, Artificial Sequence
  Synthetic oligonucleotide
gaaaggcacuuuucauucc

SEQ ID NO: 2578 - RNA, 19 nt, Artificial Sequence
  Synthetic oligonucleotide
aaaggcacuuuucauucca

SEQ ID NO: 2579 - RNA, 19 nt, Artificial Sequence
  Synthetic oligonucleotide
aaggcacuuuucauuccac

SEQ ID NO: 2580 - RNA, 19 nt, Artificial Sequence
  Synthetic oligonucleotide
aggcacuuuucauuccacu

SEQ ID NO: 2581 - RNA, 19 nt, Artificial Sequence
  Synthetic oligonucleotide
ggcacuuuucauuccacuu

SEQ ID NO: 2582 - RNA, 19 nt, Artificial Sequence
  Synthetic oligonucleotide
gcacuuuucauuccacuuu

SEQ ID NO: 2583 - RNA, 19 nt, Artificial Sequence
  Synthetic oligonucleotide
cacuuuucauuccacuuua

SEQ ID NO: 2584 - RNA, 19 nt, Artificial Sequence
  Synthetic oligonucleotide
acuuuucauuccacuuuaa

SEQ ID NO: 2585 - RNA, 19 nt, Artificial Sequence
  Synthetic oligonucleotide
cuuuucauuccacuuuaac

SEQ ID NO: 2586 - RNA, 19 nt, Artificial Sequence
  Synthetic oligonucleotide
uuuucauuccacuuuaacu

SEQ ID NO: 2587 - RNA, 19 nt, Artificial Sequence
  Synthetic oligonucleotide
uuucauuccacuuuaacuu

SEQ ID NO: 2588 - RNA, 19 nt, Artificial Sequence
  Synthetic oligonucleotide
uucauuccacuuuaacuug

SEQ ID NO: 2589 - RNA, 19 nt, Artificial Sequence
  Synthetic oligonucleotide
ucauuccacuuuaacuuga

SEQ ID NO: 2590 - RNA, 19 nt, Artificial Sequence
  Synthetic oligonucleotide
cauuccacuuuaacuugau

SEQ ID NO: 2591 - RNA, 19 nt, Artificial Sequence
  Synthetic oligonucleotide
auuccacuuuaacuugauu

SEQ ID NO: 2592 - RNA, 19 nt, Artificial Sequence
  Synthetic oligonucleotide
uuccacuuuaacuugauuu

SEQ ID NO: 2593 - RNA, 19 nt, Artificial Sequence
  Synthetic oligonucleotide
uccacuuuaacuugauuuu

SEQ ID NO: 2594 - RNA, 19 nt, Artificial Sequence
  Synthetic oligonucleotide
ccacuuuaacuugauuuuu

SEQ ID NO: 2595 - RNA, 19 nt, Artificial Sequence
  Synthetic oligonucleotide
cacuuuaacuugauuuuuu

SEQ ID NO: 2596 - RNA, 19 nt, Artificial Sequence
  Synthetic oligonucleotide
acuuuaacuugauuuuuua

SEQ ID NO: 2597 - RNA, 19 nt, Artificial Sequence
  Synthetic oligonucleotide
cuuuaacuugauuuuuuaa

SEQ ID NO: 2598 - RNA, 19 nt, Artificial Sequence
  Synthetic oligonucleotide
uuuaacuugauuuuuuaaa

SEQ ID NO: 2599 - RNA, 19 nt, Artificial Sequence
  Synthetic oligonucleotide
uuaacuugauuuuuuaaau

SEQ ID NO: 2600 - RNA, 19 nt, Artificial Sequence
  Synthetic oligonucleotide
uaacuugauuuuuuaaauu

SEQ ID NO: 2601 - RNA, 19 nt, Artificial Sequence
  Synthetic oligonucleotide
aacuugauuuuuuaaauuc

SEQ ID NO: 2602 - RNA, 19 nt, Artificial Sequence
  Synthetic oligonucleotide
acuugauuuuuuaaauucc

SEQ ID NO: 2603 - RNA, 19 nt, Artificial Sequence
  Synthetic oligonucleotide
cuugauuuuuuaaauuccc

SEQ ID NO: 2604 - RNA, 19 nt, Artificial Sequence
  Synthetic oligonucleotide
uugauuuuuuaaauucccu

SEQ ID NO: 2605 - RNA, 19 nt, Artificial Sequence
  Synthetic oligonucleotide
ugauuuuuuaaauucccuu

SEQ ID NO: 2606 - RNA, 19 nt, Artificial Sequence
  Synthetic oligonucleotide
gauuuuuuaaauucccuua

SEQ ID NO: 2607 - RNA, 19 nt, Artificial Sequence
  Synthetic oligonucleotide
auuuuuuaaauucccuuau

SEQ ID NO: 2608 - RNA, 19 nt, Artificial Sequence
  Synthetic oligonucleotide
uuuuuaaauucccuuauug

SEQ ID NO: 2609 - RNA, 19 nt, Artificial Sequence
  Synthetic oligonucleotide
aaauucccuuauugucccu

SEQ ID NO: 2610 - RNA, 19 nt, Artificial Sequence
  Synthetic oligonucleotide
aauucccuuauugucccuu

SEQ ID NO: 2611 - RNA, 19 nt, Artificial Sequence
  Synthetic oligonucleotide
ucccuuauugucccuucca

SEQ ID NO: 2612 - RNA, 19 nt, Artificial Sequence
  Synthetic oligonucleotide
aaaaagagaaucaaaauuu

SEQ ID NO: 2613 - RNA, 19 nt, Artificial Sequence
  Synthetic oligonucleotide
aaaagagaaucaaaauuuu

SEQ ID NO: 2614 - RNA, 19 nt, Artificial Sequence
  Synthetic oligonucleotide
aaagagaaucaaaauuuua

SEQ ID NO: 2615 - RNA, 19 nt, Artificial Sequence
  Synthetic oligonucleotide
aagagaaucaaaauuuuac

SEQ ID NO: 2616 - RNA, 19 nt, Artificial Sequence
  Synthetic oligonucleotide
agagaaucaaaauuuuaca

SEQ ID NO: 2617 - RNA, 19 nt, Artificial Sequence
  Synthetic oligonucleotide
gagaaucaaaauuuuacaa

SEQ ID NO: 2618 - RNA, 19 nt, Artificial Sequence
  Synthetic oligonucleotide
agaaucaaaauuuuacaaa

SEQ ID NO: 2619 - RNA, 19 nt, Artificial Sequence
  Synthetic oligonucleotide
gaaucaaaauuuuacaaag

SEQ ID NO: 2620 - RNA, 19 nt, Artificial Sequence
  Synthetic oligonucleotide
aaucaaaauuuuacaaaga

SEQ ID NO: 2621 - RNA, 19 nt, Artificial Sequence
  Synthetic oligonucleotide
aucaaaauuuuacaaagaa

SEQ ID NO: 2622 - RNA, 19 nt, Artificial Sequence
  Synthetic oligonucleotide
ucaaaauuuuacaaagaau

SEQ ID NO: 2623 - RNA, 19 nt, Artificial Sequence
  Synthetic oligonucleotide
caaaauuuuacaaagaauc

SEQ ID NO: 2624 - RNA, 19 nt, Artificial Sequence
  Synthetic oligonucleotide
aaaauuuuacaaagaauca

SEQ ID NO: 2625 - RNA, 19 nt, Artificial Sequence
  Synthetic oligonucleotide
aaauuuuacaaagaaucaa

SEQ ID NO: 2626 - RNA, 19 nt, Artificial Sequence
  Synthetic oligonucleotide
aauuuuacaaagaaucaaa

SEQ ID NO: 2627 - RNA, 19 nt, Artificial Sequence
  Synthetic oligonucleotide
uuuuacaaagaaucaaagg

SEQ ID NO: 2628 - RNA, 19 nt, Artificial Sequence
  Synthetic oligonucleotide
uuuacaaagaaucaaagga

SEQ ID NO: 2629 - RNA, 19 nt, Artificial Sequence
  Synthetic oligonucleotide
uuacaaagaaucaaaggaa

SEQ ID NO: 2630 - RNA, 19 nt, Artificial Sequence
  Synthetic oligonucleotide
uacaaagaaucaaaggaau

SEQ ID NO: 2631 - RNA, 19 nt, Artificial Sequence
  Synthetic oligonucleotide
acaaagaaucaaaggaauu

SEQ ID NO: 2632 - RNA, 19 nt, Artificial Sequence
  Synthetic oligonucleotide
caaagaaucaaaggaauuc

SEQ ID NO: 2633 - RNA, 19 nt, Artificial Sequence
  Synthetic oligonucleotide
aaagaaucaaaggaauucu

SEQ ID NO: 2634 - RNA, 19 nt, Artificial Sequence
  Synthetic oligonucleotide
aagaaucaaaggaauucua

SEQ ID NO: 2635 - RNA, 19 nt, Artificial Sequence
  Synthetic oligonucleotide
agaaucaaaggaauucuag

SEQ ID NO: 2636 - RNA, 19 nt, Artificial Sequence
  Synthetic oligonucleotide
gaaucaaaggaauucuaga

SEQ ID NO: 2637 - RNA, 19 nt, Artificial Sequence
  Synthetic oligonucleotide
aaucaaaggaauucuagaa

SEQ ID NO: 2638 - RNA, 19 nt, Artificial Sequence
  Synthetic oligonucleotide
aucaaaggaauucuagaaa

SEQ ID NO: 2639 - RNA, 19 nt, Artificial Sequence
  Synthetic oligonucleotide
ucaaaggaauucuagaaag

SEQ ID NO: 2640 - RNA, 19 nt, Artificial Sequence
  Synthetic oligonucleotide
caaaggaauucuagaaagu

SEQ ID NO: 2641 - RNA, 19 nt, Artificial Sequence
  Synthetic oligonucleotide
aaaggaauucuagaaagua

SEQ ID NO: 2642 - RNA, 19 nt, Artificial Sequence
  Synthetic oligonucleotide
aggagagauccaaauuucc

SEQ ID NO: 2643 - RNA, 19 nt, Artificial Sequence
  Synthetic oligonucleotide
ggagagauccaaauuucca

SEQ ID NO: 2644 - RNA, 19 nt, Artificial Sequence
  Synthetic oligonucleotide
gagauccaaauuuccauug

SEQ ID NO: 2645 - RNA, 19 nt, Artificial Sequence
  Synthetic oligonucleotide
agauccaaauuuccauugu

SEQ ID NO: 2646 - RNA, 19 nt, Artificial Sequence
  Synthetic oligonucleotide
gauccaaauuuccauuguc

SEQ ID NO: 2647 - RNA, 19 nt, Artificial Sequence
  Synthetic oligonucleotide
auccaaauuuccauugucu

SEQ ID NO: 2648 - RNA, 19 nt, Artificial Sequence
  Synthetic oligonucleotide
uccaaauuuccauugucuu

SEQ ID NO: 2649 - RNA, 19 nt, Artificial Sequence
  Synthetic oligonucleotide
ccaaauuuccauugucuug

SEQ ID NO: 2650 - RNA, 19 nt, Artificial Sequence
  Synthetic oligonucleotide
caaauuuccauugucuugc

SEQ ID NO: 2651 - RNA, 19 nt, Artificial Sequence
  Synthetic oligonucleotide
aaauuuccauugucuugca

SEQ ID NO: 2652 - RNA, 19 nt, Artificial Sequence
  Synthetic oligonucleotide
aauuuccauugucuugcaa

SEQ ID NO: 2653 - RNA, 19 nt, Artificial Sequence
  Synthetic oligonucleotide
auuuccauugucuugcaag

SEQ ID NO: 2654 - RNA, 19 nt, Artificial Sequence
  Synthetic oligonucleotide
uuuccauugucuugcaagc

SEQ ID NO: 2655 - RNA, 19 nt, Artificial Sequence
  Synthetic oligonucleotide
uuccauugucuugcaagca

SEQ ID NO: 2656 - RNA, 19 nt, Artificial Sequence
  Synthetic oligonucleotide
uccauugucuugcaagcaa

SEQ ID NO: 2657 - RNA, 19 nt, Artificial Sequence
  Synthetic oligonucleotide
ccauugucuugcaagcaaa

SEQ ID NO: 2658 - RNA, 19 nt, Artificial Sequence
  Synthetic oligonucleotide
cauugucuugcaagcaaag

SEQ ID NO: 2659 - RNA, 19 nt, Artificial Sequence
  Synthetic oligonucleotide
auugucuugcaagcaaagc

SEQ ID NO: 2660 - RNA, 19 nt, Artificial Sequence
  Synthetic oligonucleotide
uugucuugcaagcaaagca

SEQ ID NO: 2661 - RNA, 19 nt, Artificial Sequence
  Synthetic oligonucleotide
ugucuugcaagcaaagcac

SEQ ID NO: 2662 - RNA, 19 nt, Artificial Sequence
  Synthetic oligonucleotide
gucuugcaagcaaagcacg

SEQ ID NO: 2663 - RNA, 19 nt, Artificial Sequence
  Synthetic oligonucleotide
ucuugcaagcaaagcacgu

SEQ ID NO: 2664 - RNA, 19 nt, Artificial Sequence
  Synthetic oligonucleotide
cuugcaagcaaagcacgua

SEQ ID NO: 2665 - RNA, 19 nt, Artificial Sequence
  Synthetic oligonucleotide
uugcaagcaaagcacguau

SEQ ID NO: 2666 - RNA, 19 nt, Artificial Sequence
  Synthetic oligonucleotide
ugcaagcaaagcacguauu

SEQ ID NO: 2667 - RNA, 19 nt, Artificial Sequence
  Synthetic oligonucleotide
gcaagcaaagcacguauua

SEQ ID NO: 2668 - RNA, 19 nt, Artificial Sequence
  Synthetic oligonucleotide
caagcaaagcacguauuaa

SEQ ID NO: 2669 - RNA, 19 nt, Artificial Sequence
  Synthetic oligonucleotide
aagcaaagcacguauuaaa

SEQ ID NO: 2670 - RNA, 19 nt, Artificial Sequence
  Synthetic oligonucleotide
agcaaagcacguauuaaau

SEQ ID NO: 2671 - RNA, 19 nt, Artificial Sequence
  Synthetic oligonucleotide
gcaaagcacguauuaaaua

SEQ ID NO: 2672 - RNA, 19 nt, Artificial Sequence
  Synthetic oligonucleotide
caaagcacguauuaaauau

SEQ ID NO: 2673 - RNA, 19 nt, Artificial Sequence
  Synthetic oligonucleotide
aaagcacguauuaaauaug

SEQ ID NO: 2674 - RNA, 19 nt, Artificial Sequence
  Synthetic oligonucleotide
aagcacguauuaaauauga

SEQ ID NO: 2675 - RNA, 19 nt, Artificial Sequence
  Synthetic oligonucleotide
agcacguauuaaauaugau

SEQ ID NO: 2676 - RNA, 19 nt, Artificial Sequence
  Synthetic oligonucleotide
gcacguauuaaauaugauc

SEQ ID NO: 2677 - RNA, 19 nt, Artificial Sequence
  Synthetic oligonucleotide
cacguauuaaauaugaucu

SEQ ID NO: 2678 - RNA, 19 nt, Artificial Sequence
  Synthetic oligonucleotide
cguauuaaauaugaucugc

SEQ ID NO: 2679 - RNA, 19 nt, Artificial Sequence
  Synthetic oligonucleotide
guauuaaauaugaucugca

SEQ ID NO: 2680 - RNA, 19 nt, Artificial Sequence
  Synthetic oligonucleotide
auuaaauaugaucugcagc

SEQ ID NO: 2681 - RNA, 19 nt, Artificial Sequence
  Synthetic oligonucleotide
uuaaauaugaucugcagcc

SEQ ID NO: 2682 - RNA, 19 nt, Artificial Sequence
  Synthetic oligonucleotide
uaaauaugaucugcagcca

SEQ ID NO: 2683 - RNA, 19 nt, Artificial Sequence
  Synthetic oligonucleotide
aaauaugaucugcagccau

SEQ ID NO: 2684 - RNA, 19 nt, Artificial Sequence
  Synthetic oligonucleotide
aauaugaucugcagccauu

SEQ ID NO: 2685 - RNA, 19 nt, Artificial Sequence
  Synthetic oligonucleotide
auaugaucugcagccauua

SEQ ID NO: 2686 - RNA, 19 nt, Artificial Sequence
  Synthetic oligonucleotide
uaugaucugcagccauuaa

SEQ ID NO: 2687 - RNA, 19 nt, Artificial Sequence
  Synthetic oligonucleotide
augaucugcagccauuaaa

SEQ ID NO: 2688 - RNA, 19 nt, Artificial Sequence
  Synthetic oligonucleotide
ugaucugcagccauuaaaa

SEQ ID NO: 2689 - RNA, 19 nt, Artificial Sequence
  Synthetic oligonucleotide
uugacuaagucaauaauca

SEQ ID NO: 2690 - RNA, 19 nt, Artificial Sequence
  Synthetic oligonucleotide
ugacuaagucaauaaucag

SEQ ID NO: 2691 - RNA, 19 nt, Artificial Sequence
  Synthetic oligonucleotide
gacuaagucaauaaucaga

SEQ ID NO: 2692 - RNA, 19 nt, Artificial Sequence
  Synthetic oligonucleotide
acuaagucaauaaucagaa

SEQ ID NO: 2693 - RNA, 19 nt, Artificial Sequence
  Synthetic oligonucleotide
cuaagucaauaaucagaau

SEQ ID NO: 2694 - RNA, 19 nt, Artificial Sequence
  Synthetic oligonucleotide
uaagucaauaaucagaauc

SEQ ID NO: 2695 - RNA, 19 nt, Artificial Sequence
  Synthetic oligonucleotide
aagucaauaaucagaauca

SEQ ID NO: 2696 - RNA, 19 nt, Artificial Sequence
  Synthetic oligonucleotide
agucaauaaucagaaucag

SEQ ID NO: 2697 - RNA, 19 nt, Artificial Sequence
  Synthetic oligonucleotide
gucaauaaucagaaucagc

SEQ ID NO: 2698 - RNA, 19 nt, Artificial Sequence
  Synthetic oligonucleotide
ucaauaaucagaaucagca

SEQ ID NO: 2699 - RNA, 19 nt, Artificial Sequence
  Synthetic oligonucleotide
caauaaucagaaucagcag

SEQ ID NO: 2700 - RNA, 19 nt, Artificial Sequence
  Synthetic oligonucleotide
aauaaucagaaucagcagg

SEQ ID NO: 2701 - RNA, 19 nt, Artificial Sequence
  Synthetic oligonucleotide
auaaucagaaucagcaggu

SEQ ID NO: 2702 - RNA, 19 nt, Artificial Sequence
  Synthetic oligonucleotide
uaaucagaaucagcagguu

SEQ ID NO: 2703 - RNA, 19 nt, Artificial Sequence
  Synthetic oligonucleotide
aaucagaaucagcagguuu

SEQ ID NO: 2704 - RNA, 19 nt, Artificial Sequence
  Synthetic oligonucleotide
ucagaaucagcagguuugc

SEQ ID NO: 2705 - RNA, 19 nt, Artificial Sequence
  Synthetic oligonucleotide
cagaaucagcagguuugca

SEQ ID NO: 2706 - RNA, 19 nt, Artificial Sequence
  Synthetic oligonucleotide
gaaucagcagguuugcagu

SEQ ID NO: 2707 - RNA, 19 nt, Artificial Sequence
  Synthetic oligonucleotide
aaucagcagguuugcaguc

SEQ ID NO: 2708 - RNA, 19 nt, Artificial Sequence
  Synthetic oligonucleotide
ugcagucagauuggcaggg

SEQ ID NO: 2709 - RNA, 19 nt, Artificial Sequence
  Synthetic oligonucleotide
agccuagcucaggagaagu

SEQ ID NO: 2710 - RNA, 19 nt, Artificial Sequence
  Synthetic oligonucleotide
cuagcucaggagaagugag

SEQ ID NO: 2711 - RNA, 19 nt, Artificial Sequence
  Synthetic oligonucleotide
uagcucaggagaagugagu

SEQ ID NO: 2712 - RNA, 19 nt, Artificial Sequence
  Synthetic oligonucleotide
agcucaggagaagugagua

SEQ ID NO: 2713 - RNA, 19 nt, Artificial Sequence
  Synthetic oligonucleotide
gcucaggagaagugaguau

SEQ ID NO: 2714 - RNA, 19 nt, Artificial Sequence
  Synthetic oligonucleotide
ucaggagaagugaguauaa

SEQ ID NO: 2715 - RNA, 19 nt, Artificial Sequence
  Synthetic oligonucleotide
agcagccaucacagaaguc

SEQ ID NO: 2716 - RNA, 19 nt, Artificial Sequence
  Synthetic oligonucleotide
gcagccaucacagaagucc

SEQ ID NO: 2717 - RNA, 19 nt, Artificial Sequence
  Synthetic oligonucleotide
cagccaucacagaagucca

SEQ ID NO: 2718 - RNA, 19 nt, Artificial Sequence
  Synthetic oligonucleotide
agccaucacagaaguccac

SEQ ID NO: 2719 - RNA, 19 nt, Artificial Sequence
  Synthetic oligonucleotide
gccaucacagaaguccacu

SEQ ID NO: 2720 - RNA, 19 nt, Artificial Sequence
  Synthetic oligonucleotide
ccaucacagaaguccacuc

SEQ ID NO: 2721 - RNA, 19 nt, Artificial Sequence
  Synthetic oligonucleotide
caucacagaaguccacuca

SEQ ID NO: 2722 - RNA, 19 nt, Artificial Sequence
  Synthetic oligonucleotide
ucacagaaguccacucauu

SEQ ID NO: 2723 - RNA, 19 nt, Artificial Sequence
  Synthetic oligonucleotide
cacagaaguccacucauuc

SEQ ID NO: 2724 - RNA, 19 nt, Artificial Sequence
  Synthetic oligonucleotide
auucuuggcaggauggcuu

SEQ ID NO: 2725 - RNA, 19 nt, Artificial Sequence
  Synthetic oligonucleotide
uucuuggcaggauggcuuc

SEQ ID NO: 2726 - RNA, 19 nt, Artificial Sequence
  Synthetic oligonucleotide
ucuuggcaggauggcuucu

SEQ ID NO: 2727 - RNA, 19 nt, Artificial Sequence
  Synthetic oligonucleotide
cuuggcaggauggcuucuc

SEQ ID NO: 2728 - RNA, 19 nt, Artificial Sequence
  Synthetic oligonucleotide
uuggcaggauggcuucuca

SEQ ID NO: 2729 - RNA, 19 nt, Artificial Sequence
  Synthetic oligonucleotide
uggcaggauggcuucucau

SEQ ID NO: 2730 - RNA, 19 nt, Artificial Sequence
  Synthetic oligonucleotide
ggcaggauggcuucucauc

SEQ ID NO: 2731 - RNA, 19 nt, Artificial Sequence
  Synthetic oligonucleotide
gcaggauggcuucucaucg

SEQ ID NO: 2732 - RNA, 19 nt, Artificial Sequence
  Synthetic oligonucleotide
caggauggcuucucaucgu

SEQ ID NO: 2733 - RNA, 19 nt, Artificial Sequence
  Synthetic oligonucleotide
aggauggcuucucaucguc

SEQ ID NO: 2734 - RNA, 19 nt, Artificial Sequence
  Synthetic oligonucleotide
ggauggcuucucaucgucu

SEQ ID NO: 2735 - RNA, 19 nt, Artificial Sequence
  Synthetic oligonucleotide
gauggcuucucaucgucug

SEQ ID NO: 2736 - RNA, 19 nt, Artificial Sequence
  Synthetic oligonucleotide
auggcuucucaucgucugc

SEQ ID NO: 2737 - RNA, 19 nt, Artificial Sequence
  Synthetic oligonucleotide
uggcuucucaucgucugcu

SEQ ID NO: 2738 - RNA, 19 nt, Artificial Sequence
  Synthetic oligonucleotide
ggcuucucaucgucugcuc

SEQ ID NO: 2739 - RNA, 19 nt, Artificial Sequence
  Synthetic oligonucleotide
gcuucucaucgucugcucc

SEQ ID NO: 2740 - RNA, 19 nt, Artificial Sequence
  Synthetic oligonucleotide
cucugccuugcuggacugg

SEQ ID NO: 2741 - RNA, 19 nt, Artificial Sequence
  Synthetic oligonucleotide
ucugccuugcuggacuggu

SEQ ID NO: 2742 - RNA, 19 nt, Artificial Sequence
  Synthetic oligonucleotide
accggugaauccaaguguc

SEQ ID NO: 2743 - RNA, 19 nt, Artificial Sequence
  Synthetic oligonucleotide
gugaauccaaguguccucu

SEQ ID NO: 2744 - RNA, 19 nt, Artificial Sequence
  Synthetic oligonucleotide
ugaauccaaguguccucug

SEQ ID NO: 2745 - RNA, 19 nt, Artificial Sequence
  Synthetic oligonucleotide
gaauccaaguguccucuga

SEQ ID NO: 2746 - RNA, 19 nt, Artificial Sequence
  Synthetic oligonucleotide
aauccaaguguccucugau

SEQ ID NO: 2747 - RNA, 19 nt, Artificial Sequence
  Synthetic oligonucleotide
auccaaguguccucugaug

SEQ ID NO: 2748 - RNA, 19 nt, Artificial Sequence
  Synthetic oligonucleotide
uccaaguguccucugaugg

SEQ ID NO: 2749 - RNA, 19 nt, Artificial Sequence
  Synthetic oligonucleotide
ccaaguguccucugauggu

SEQ ID NO: 2750 - RNA, 19 nt, Artificial Sequence
  Synthetic oligonucleotide
caaguguccucugaugguc

SEQ ID NO: 2751 - RNA, 19 nt, Artificial Sequence
  Synthetic oligonucleotide
aaguguccucugaugguca

SEQ ID NO: 2752 - RNA, 19 nt, Artificial Sequence
  Synthetic oligonucleotide
aguguccucugauggucaa

SEQ ID NO: 2753 - RNA, 19 nt, Artificial Sequence
  Synthetic oligonucleotide
guguccucugauggucaaa

SEQ ID NO: 2754 - RNA, 19 nt, Artificial Sequence
  Synthetic oligonucleotide
uguccucugauggucaaag

SEQ ID NO: 2755 - RNA, 19 nt, Artificial Sequence
  Synthetic oligonucleotide
guccucugauggucaaagu

SEQ ID NO: 2756 - RNA, 19 nt, Artificial Sequence
  Synthetic oligonucleotide
uccucugauggucaaaguu

SEQ ID NO: 2757 - RNA, 19 nt, Artificial Sequence
  Synthetic oligonucleotide
ccucugauggucaaaguuc

SEQ ID NO: 2758 - RNA, 19 nt, Artificial Sequence
  Synthetic oligonucleotide
cucugauggucaaaguucu

SEQ ID NO: 2759 - RNA, 19 nt, Artificial Sequence
  Synthetic oligonucleotide
ucugauggucaaaguucua

SEQ ID NO: 2760 - RNA, 19 nt, Artificial Sequence
  Synthetic oligonucleotide
cugauggucaaaguucuag

SEQ ID NO: 2761 - RNA, 19 nt, Artificial Sequence
  Synthetic oligonucleotide
ugauggucaaaguucuaga

SEQ ID NO: 2762 - RNA, 19 nt, Artificial Sequence
  Synthetic oligonucleotide
gauggucaaaguucuagau

SEQ ID NO: 2763 - RNA, 19 nt, Artificial Sequence
  Synthetic oligonucleotide
auggucaaaguucuagaug

SEQ ID NO: 2764 - RNA, 19 nt, Artificial Sequence
  Synthetic oligonucleotide
agccauuugccucugggaa

SEQ ID NO: 2765 - RNA, 19 nt, Artificial Sequence
  Synthetic oligonucleotide
gccauuugccucugggaaa

SEQ ID NO: 2766 - RNA, 19 nt, Artificial Sequence
  Synthetic oligonucleotide
ccauuugccucugggaaaa

SEQ ID NO: 2767 - RNA, 19 nt, Artificial Sequence
  Synthetic oligonucleotide
cauuugccucugggaaaac

SEQ ID NO: 2768 - RNA, 19 nt, Artificial Sequence
  Synthetic oligonucleotide
auuugccucugggaaaacc

SEQ ID NO: 2769 - RNA, 19 nt, Artificial Sequence
  Synthetic oligonucleotide
uuugccucugggaaaacca

SEQ ID NO: 2770 - RNA, 19 nt, Artificial Sequence
  Synthetic oligonucleotide
uugccucugggaaaaccag

SEQ ID NO: 2771 - RNA, 19 nt, Artificial Sequence
  Synthetic oligonucleotide
ugccucugggaaaaccagu

SEQ ID NO: 2772 - RNA, 19 nt, Artificial Sequence
  Synthetic oligonucleotide
gccucugggaaaaccagug

SEQ ID NO: 2773 - RNA, 19 nt, Artificial Sequence
  Synthetic oligonucleotide
ccucugggaaaaccaguga

SEQ ID NO: 2774 - RNA, 19 nt, Artificial Sequence
  Synthetic oligonucleotide
cucugggaaaaccagugag

SEQ ID NO: 2775 - RNA, 19 nt, Artificial Sequence
  Synthetic oligonucleotide
ucugggaaaaccagugagu

SEQ ID NO: 2776 - RNA, 19 nt, Artificial Sequence
  Synthetic oligonucleotide
cugggaaaaccagugaguc

SEQ ID NO: 2777 - RNA, 19 nt, Artificial Sequence
  Synthetic oligonucleotide
ugggaaaaccagugagucu

SEQ ID NO: 2778 - RNA, 19 nt, Artificial Sequence
  Synthetic oligonucleotide
gggaaaaccagugagucug

SEQ ID NO: 2779 - RNA, 19 nt, Artificial Sequence
  Synthetic oligonucleotide
ggaaaaccagugagucugg

SEQ ID NO: 2780 - RNA, 19 nt, Artificial Sequence
  Synthetic oligonucleotide
gagcugcaugggcucacaa

SEQ ID NO: 2781 - RNA, 19 nt, Artificial Sequence
  Synthetic oligonucleotide
agcugcaugggcucacaac

SEQ ID NO: 2782 - RNA, 19 nt, Artificial Sequence
  Synthetic oligonucleotide
gcugcaugggcucacaacu

SEQ ID NO: 2783 - RNA, 19 nt, Artificial Sequence
  Synthetic oligonucleotide
cugcaugggcucacaacug

SEQ ID NO: 2784 - RNA, 19 nt, Artificial Sequence
  Synthetic oligonucleotide
ugcaugggcucacaacuga

SEQ ID NO: 2785 - RNA, 19 nt, Artificial Sequence
  Synthetic oligonucleotide
gcaugggcucacaacugag

SEQ ID NO: 2786 - RNA, 19 nt, Artificial Sequence
  Synthetic oligonucleotide
caugggcucacaacugagg

SEQ ID NO: 2787 - RNA, 19 nt, Artificial Sequence
  Synthetic oligonucleotide
augggcucacaacugagga

SEQ ID NO: 2788 - RNA, 19 nt, Artificial Sequence
  Synthetic oligonucleotide
ugggcucacaacugaggag

SEQ ID NO: 2789 - RNA, 19 nt, Artificial Sequence
  Synthetic oligonucleotide
gggcucacaacugaggagg

SEQ ID NO: 2790 - RNA, 19 nt, Artificial Sequence
  Synthetic oligonucleotide
ggcucacaacugaggagga

SEQ ID NO: 2791 - RNA, 19 nt, Artificial Sequence
  Synthetic oligonucleotide
gcucacaacugaggaggaa

SEQ ID NO: 2792 - RNA, 19 nt, Artificial Sequence
  Synthetic oligonucleotide
cucacaacugaggaggaau

SEQ ID NO: 2793 - RNA, 19 nt, Artificial Sequence
  Synthetic oligonucleotide
ucacaacugaggaggaauu

SEQ ID NO: 2794 - RNA, 19 nt, Artificial Sequence
  Synthetic oligonucleotide
cacaacugaggaggaauuu

SEQ ID NO: 2795 - RNA, 19 nt, Artificial Sequence
  Synthetic oligonucleotide
acaacugaggaggaauuug

SEQ ID NO: 2796 - RNA, 19 nt, Artificial Sequence
  Synthetic oligonucleotide
aacugaggaggaauuugua

SEQ ID NO: 2797 - RNA, 19 nt, Artificial Sequence
  Synthetic oligonucleotide
acugaggaggaauuuguag

SEQ ID NO: 2798 - RNA, 19 nt, Artificial Sequence
  Synthetic oligonucleotide
cugaggaggaauuuguaga

SEQ ID NO: 2799 - RNA, 19 nt, Artificial Sequence
  Synthetic oligonucleotide
ugaggaggaauuuguagaa

SEQ ID NO: 2800 - RNA, 19 nt, Artificial Sequence
  Synthetic oligonucleotide
gaggaggaauuuguagaag

SEQ ID NO: 2801 - RNA, 19 nt, Artificial Sequence
  Synthetic oligonucleotide
aggaggaauuuguagaagg

SEQ ID NO: 2802 - RNA, 19 nt, Artificial Sequence
  Synthetic oligonucleotide
ggaggaauuuguagaaggg

SEQ ID NO: 2803 - RNA, 19 nt, Artificial Sequence
  Synthetic oligonucleotide
gaggaauuuguagaaggga

SEQ ID NO: 2804 - RNA, 19 nt, Artificial Sequence
  Synthetic oligonucleotide
aggaauuuguagaagggau

SEQ ID NO: 2805 - RNA, 19 nt, Artificial Sequence
  Synthetic oligonucleotide
ggaauuuguagaagggaua

SEQ ID NO: 2806 - RNA, 19 nt, Artificial Sequence
  Synthetic oligonucleotide
gaauuuguagaagggauau

SEQ ID NO: 2807 - RNA, 19 nt, Artificial Sequence
  Synthetic oligonucleotide
aauuuguagaagggauaua

SEQ ID NO: 2808 - RNA, 19 nt, Artificial Sequence
  Synthetic oligonucleotide
auuuguagaagggauauac

SEQ ID NO: 2809 - RNA, 19 nt, Artificial Sequence
  Synthetic oligonucleotide
uuuguagaagggauauaca

SEQ ID NO: 2810 - RNA, 19 nt, Artificial Sequence
  Synthetic oligonucleotide
uuguagaagggauauacaa

SEQ ID NO: 2811 - RNA, 19 nt, Artificial Sequence
  Synthetic oligonucleotide
uguagaagggauauacaaa

SEQ ID NO: 2812 - RNA, 19 nt, Artificial Sequence
  Synthetic oligonucleotide
guagaagggauauacaaag

SEQ ID NO: 2813 - RNA, 19 nt, Artificial Sequence
  Synthetic oligonucleotide
uagaagggauauacaaagu

SEQ ID NO: 2814 - RNA, 19 nt, Artificial Sequence
  Synthetic oligonucleotide
agaagggauauacaaagug

SEQ ID NO: 2815 - RNA, 19 nt, Artificial Sequence
  Synthetic oligonucleotide
gaagggauauacaaagugg

SEQ ID NO: 2816 - RNA, 19 nt, Artificial Sequence
  Synthetic oligonucleotide
aagggauauacaaagugga

SEQ ID NO: 2817 - RNA, 19 nt, Artificial Sequence
  Synthetic oligonucleotide
agggauauacaaaguggaa

SEQ ID NO: 2818 - RNA, 19 nt, Artificial Sequence
  Synthetic oligonucleotide
gggauauacaaaguggaaa

SEQ ID NO: 2819 - RNA, 19 nt, Artificial Sequence
  Synthetic oligonucleotide
ggauauacaaaguggaaau

SEQ ID NO: 2820 - RNA, 19 nt, Artificial Sequence
  Synthetic oligonucleotide
gauauacaaaguggaaaua

SEQ ID NO: 2821 - RNA, 19 nt, Artificial Sequence
  Synthetic oligonucleotide
auauacaaaguggaaauag

SEQ ID NO: 2822 - RNA, 19 nt, Artificial Sequence
  Synthetic oligonucleotide
uauacaaaguggaaauaga

SEQ ID NO: 2823 - RNA, 19 nt, Artificial Sequence
  Synthetic oligonucleotide
auacaaaguggaaauagac

SEQ ID NO: 2824 - RNA, 19 nt, Artificial Sequence
  Synthetic oligonucleotide
uacaaaguggaaauagaca

SEQ ID NO: 2825 - RNA, 19 nt, Artificial Sequence
  Synthetic oligonucleotide
acaaaguggaaauagacac

SEQ ID NO: 2826 - RNA, 19 nt, Artificial Sequence
  Synthetic oligonucleotide
caaaguggaaauagacacc

SEQ ID NO: 2827 - RNA, 19 nt, Artificial Sequence
  Synthetic oligonucleotide
aaaguggaaauagacacca

SEQ ID NO: 2828 - RNA, 19 nt, Artificial Sequence
  Synthetic oligonucleotide
aaguggaaauagacaccaa

SEQ ID NO: 2829 - RNA, 19 nt, Artificial Sequence
  Synthetic oligonucleotide
aguggaaauagacaccaaa

SEQ ID NO: 2830 - RNA, 19 nt, Artificial Sequence
  Synthetic oligonucleotide
guggaaauagacaccaaau

SEQ ID NO: 2831 - RNA, 19 nt, Artificial Sequence
  Synthetic oligonucleotide
uggaaauagacaccaaauc

SEQ ID NO: 2832 - RNA, 19 nt, Artificial Sequence
  Synthetic oligonucleotide
ggaaauagacaccaaaucu

SEQ ID NO: 2833 - RNA, 19 nt, Artificial Sequence
  Synthetic oligonucleotide
gaaauagacaccaaaucuu

SEQ ID NO: 2834 - RNA, 19 nt, Artificial Sequence
  Synthetic oligonucleotide
aaauagacaccaaaucuua

SEQ ID NO: 2835 - RNA, 19 nt, Artificial Sequence
  Synthetic oligonucleotide
aauagacaccaaaucuuac

SEQ ID NO: 2836 - RNA, 19 nt, Artificial Sequence
  Synthetic oligonucleotide
uagacaccaaaucuuacug

SEQ ID NO: 2837 - RNA, 19 nt, Artificial Sequence
  Synthetic oligonucleotide
agacaccaaaucuuacugg

SEQ ID NO: 2838 - RNA, 19 nt, Artificial Sequence
  Synthetic oligonucleotide
gcacuuggcaucuccccau

SEQ ID NO: 2839 - RNA, 19 nt, Artificial Sequence
  Synthetic oligonucleotide
cacuuggcaucuccccauu

SEQ ID NO: 2840 - RNA, 19 nt, Artificial Sequence
  Synthetic oligonucleotide
acuuggcaucuccccauuc

SEQ ID NO: 2841 - RNA, 19 nt, Artificial Sequence
  Synthetic oligonucleotide
cuuggcaucuccccauucc

SEQ ID NO: 2842 - RNA, 19 nt, Artificial Sequence
  Synthetic oligonucleotide
uuggcaucuccccauucca

SEQ ID NO: 2843 - RNA, 19 nt, Artificial Sequence
  Synthetic oligonucleotide
uggcaucuccccauuccau

SEQ ID NO: 2844 - RNA, 19 nt, Artificial Sequence
  Synthetic oligonucleotide
ggcaucuccccauuccaug

SEQ ID NO: 2845 - RNA, 19 nt, Artificial Sequence
  Synthetic oligonucleotide
gcaucuccccauuccauga

SEQ ID NO: 2846 - RNA, 19 nt, Artificial Sequence
  Synthetic oligonucleotide
caucuccccauuccaugag

SEQ ID NO: 2847 - RNA, 19 nt, Artificial Sequence
  Synthetic oligonucleotide
aucuccccauuccaugagc

SEQ ID NO: 2848 - RNA, 19 nt, Artificial Sequence
  Synthetic oligonucleotide
ucuccccauuccaugagca

SEQ ID NO: 2849 - RNA, 19 nt, Artificial Sequence
  Synthetic oligonucleotide
cuccccauuccaugagcau

SEQ ID NO: 2850 - RNA, 19 nt, Artificial Sequence
  Synthetic oligonucleotide
uccccauuccaugagcaug

SEQ ID NO: 2851 - RNA, 19 nt, Artificial Sequence
  Synthetic oligonucleotide
ccaugagcaugcagaggug

SEQ ID NO: 2852 - RNA, 19 nt, Artificial Sequence
  Synthetic oligonucleotide
caugagcaugcagaggugg

SEQ ID NO: 2853 - RNA, 19 nt, Artificial Sequence
  Synthetic oligonucleotide
augagcaugcagagguggu

SEQ ID NO: 2854 - RNA, 19 nt, Artificial Sequence
  Synthetic oligonucleotide
ugagcaugcagagguggua

SEQ ID NO: 2855 - RNA, 19 nt, Artificial Sequence
  Synthetic oligonucleotide
caugcagaggugguauuca

SEQ ID NO: 2856 - RNA, 19 nt, Artificial Sequence
  Synthetic oligonucleotide
cagaggugguauucacagc

SEQ ID NO: 2857 - RNA, 19 nt, Artificial Sequence
  Synthetic oligonucleotide
agaggugguauucacagcc

SEQ ID NO: 2858 - RNA, 19 nt, Artificial Sequence
  Synthetic oligonucleotide
ugucgucaccaaucccaag

SEQ ID NO: 2859 - RNA, 19 nt, Artificial Sequence
  Synthetic oligonucleotide
aggacgagggaugggauuu

SEQ ID NO: 2860 - RNA, 19 nt, Artificial Sequence
  Synthetic oligonucleotide
ggacgagggaugggauuuc

SEQ ID NO: 2861 - RNA, 19 nt, Artificial Sequence
  Synthetic oligonucleotide
cgagggaugggauuucaug

SEQ ID NO: 2862 - RNA, 19 nt, Artificial Sequence
  Synthetic oligonucleotide
gagggaugggauuucaugu

SEQ ID NO: 2863 - RNA, 19 nt, Artificial Sequence
  Synthetic oligonucleotide
agggaugggauuucaugua

SEQ ID NO: 2864 - RNA, 19 nt, Artificial Sequence
  Synthetic oligonucleotide
ggaugggauuucauguaac

SEQ ID NO: 2865 - RNA, 19 nt, Artificial Sequence
  Synthetic oligonucleotide
gaugggauuucauguaacc

SEQ ID NO: 2866 - RNA, 19 nt, Artificial Sequence
  Synthetic oligonucleotide
augggauuucauguaacca

SEQ ID NO: 2867 - RNA, 19 nt, Artificial Sequence
  Synthetic oligonucleotide
ugggauuucauguaaccaa

SEQ ID NO: 2868 - RNA, 19 nt, Artificial Sequence
  Synthetic oligonucleotide
gggauuucauguaaccaag

SEQ ID NO: 2869 - RNA, 19 nt, Artificial Sequence
  Synthetic oligonucleotide
ggauuucauguaaccaaga

SEQ ID NO: 2870 - RNA, 19 nt, Artificial Sequence
  Synthetic oligonucleotide
gauuucauguaaccaagag

SEQ ID NO: 2871 - RNA, 19 nt, Artificial Sequence
  Synthetic oligonucleotide
auuucauguaaccaagagu

SEQ ID NO: 2872 - RNA, 19 nt, Artificial Sequence
  Synthetic oligonucleotide
uuucauguaaccaagagua

SEQ ID NO: 2873 - RNA, 19 nt, Artificial Sequence
  Synthetic oligonucleotide
uucauguaaccaagaguau

SEQ ID NO: 2874 - RNA, 19 nt, Artificial Sequence
  Synthetic oligonucleotide
ucauguaaccaagaguauu

SEQ ID NO: 2875 - RNA, 19 nt, Artificial Sequence
  Synthetic oligonucleotide
cauguaaccaagaguauuc

SEQ ID NO: 2876 - RNA, 19 nt, Artificial Sequence
  Synthetic oligonucleotide
auguaaccaagaguauucc

SEQ ID NO: 2877 - RNA, 19 nt, Artificial Sequence
  Synthetic oligonucleotide
uguaaccaagaguauucca

SEQ ID NO: 2878 - RNA, 19 nt, Artificial Sequence
  Synthetic oligonucleotide
guaaccaagaguauuccau

SEQ ID NO: 2879 - RNA, 19 nt, Artificial Sequence
  Synthetic oligonucleotide
uaaccaagaguauuccauu

SEQ ID NO: 2880 - RNA, 19 nt, Artificial Sequence
  Synthetic oligonucleotide
aaccaagaguauuccauuu

SEQ ID NO: 2881 - RNA, 19 nt, Artificial Sequence
  Synthetic oligonucleotide
accaagaguauuccauuuu

SEQ ID NO: 2882 - RNA, 19 nt, Artificial Sequence
  Synthetic oligonucleotide
ccaagaguauuccauuuuu

SEQ ID NO: 2883 - RNA, 19 nt, Artificial Sequence
  Synthetic oligonucleotide
caagaguauuccauuuuua

SEQ ID NO: 2884 - RNA, 19 nt, Artificial Sequence
  Synthetic oligonucleotide
aagaguauuccauuuuuac

SEQ ID NO: 2885 - RNA, 19 nt, Artificial Sequence
  Synthetic oligonucleotide
agaguauuccauuuuuacu

SEQ ID NO: 2886 - RNA, 19 nt, Artificial Sequence
  Synthetic oligonucleotide
gaguauuccauuuuuacua

SEQ ID NO: 2887 - RNA, 19 nt, Artificial Sequence
  Synthetic oligonucleotide
aguauuccauuuuuacuaa

SEQ ID NO: 2888 - RNA, 19 nt, Artificial Sequence
  Synthetic oligonucleotide
guauuccauuuuuacuaaa

SEQ ID NO: 2889 - RNA, 19 nt, Artificial Sequence
  Synthetic oligonucleotide
uauuccauuuuuacuaaag

SEQ ID NO: 2890 - RNA, 19 nt, Artificial Sequence
  Synthetic oligonucleotide
auuccauuuuuacuaaagc

SEQ ID NO: 2891 - RNA, 19 nt, Artificial Sequence
  Synthetic oligonucleotide
uuccauuuuuacuaaagca

SEQ ID NO: 2892 - RNA, 19 nt, Artificial Sequence
  Synthetic oligonucleotide
uccauuuuuacuaaagcag

SEQ ID NO: 2893 - RNA, 19 nt, Artificial Sequence
  Synthetic oligonucleotide
ccauuuuuacuaaagcagu

SEQ ID NO: 2894 - RNA, 19 nt, Artificial Sequence
  Synthetic oligonucleotide
cauuuuuacuaaagcagug

SEQ ID NO: 2895 - RNA, 19 nt, Artificial Sequence
  Synthetic oligonucleotide
auuuuuacuaaagcagugu

SEQ ID NO: 2896 - RNA, 19 nt, Artificial Sequence
  Synthetic oligonucleotide
uuuuuacuaaagcaguguu

SEQ ID NO: 2897 - RNA, 19 nt, Artificial Sequence
  Synthetic oligonucleotide
uuuuacuaaagcaguguuu

SEQ ID NO: 2898 - RNA, 19 nt, Artificial Sequence
  Synthetic oligonucleotide
uuuacuaaagcaguguuuu

SEQ ID NO: 2899 - RNA, 19 nt, Artificial Sequence
  Synthetic oligonucleotide
uuacuaaagcaguguuuuc

SEQ ID NO: 2900 - RNA, 19 nt, Artificial Sequence
  Synthetic oligonucleotide
uacuaaagcaguguuuuca

SEQ ID NO: 2901 - RNA, 19 nt, Artificial Sequence
  Synthetic oligonucleotide
acuaaagcaguguuuucac

SEQ ID NO: 2902 - RNA, 19 nt, Artificial Sequence
  Synthetic oligonucleotide
cuaaagcaguguuuucacc

SEQ ID NO: 2903 - RNA, 19 nt, Artificial Sequence
  Synthetic oligonucleotide
uaaagcaguguuuucaccu

SEQ ID NO: 2904 - RNA, 19 nt, Artificial Sequence
  Synthetic oligonucleotide
aaagcaguguuuucaccuc

SEQ ID NO: 2905 - RNA, 19 nt, Artificial Sequence
  Synthetic oligonucleotide
aagcaguguuuucaccuca

SEQ ID NO: 2906 - RNA, 19 nt, Artificial Sequence
  Synthetic oligonucleotide
agcaguguuuucaccucau

SEQ ID NO: 2907 - RNA, 19 nt, Artificial Sequence
  Synthetic oligonucleotide
gcaguguuuucaccucaua

SEQ ID NO: 2908 - RNA, 19 nt, Artificial Sequence
  Synthetic oligonucleotide
caguguuuucaccucauau

SEQ ID NO: 2909 - RNA, 19 nt, Artificial Sequence
  Synthetic oligonucleotide
aguguuuucaccucauaug

SEQ ID NO: 2910 - RNA, 19 nt, Artificial Sequence
  Synthetic oligonucleotide
guguuuucaccucauaugc

SEQ ID NO: 2911 - RNA, 19 nt, Artificial Sequence
  Synthetic oligonucleotide
uguuuucaccucauaugcu

SEQ ID NO: 2912 - RNA, 19 nt, Artificial Sequence
  Synthetic oligonucleotide
guuuucaccucauaugcua

SEQ ID NO: 2913 - RNA, 19 nt, Artificial Sequence
  Synthetic oligonucleotide
uuuucaccucauaugcuau

SEQ ID NO: 2914 - RNA, 19 nt, Artificial Sequence
  Synthetic oligonucleotide
uuucaccucauaugcuaug

SEQ ID NO: 2915 - RNA, 19 nt, Artificial Sequence
  Synthetic oligonucleotide
uucaccucauaugcuaugu

SEQ ID NO: 2916 - RNA, 19 nt, Artificial Sequence
  Synthetic oligonucleotide
ucaccucauaugcuauguu

SEQ ID NO: 2917 - RNA, 19 nt, Artificial Sequence
  Synthetic oligonucleotide
caccucauaugcuauguua

SEQ ID NO: 2918 - RNA, 19 nt, Artificial Sequence
  Synthetic oligonucleotide
accucauaugcuauguuag

SEQ ID NO: 2919 - RNA, 19 nt, Artificial Sequence
  Synthetic oligonucleotide
ccucauaugcuauguuaga

SEQ ID NO: 2920 - RNA, 19 nt, Artificial Sequence
  Synthetic oligonucleotide
cucauaugcuauguuagaa

SEQ ID NO: 2921 - RNA, 19 nt, Artificial Sequence
  Synthetic oligonucleotide
ucauaugcuauguuagaag

SEQ ID NO: 2922 - RNA, 19 nt, Artificial Sequence
  Synthetic oligonucleotide
cauaugcuauguuagaagu

SEQ ID NO: 2923 - RNA, 19 nt, Artificial Sequence
  Synthetic oligonucleotide
auaugcuauguuagaaguc

SEQ ID NO: 2924 - RNA, 19 nt, Artificial Sequence
  Synthetic oligonucleotide
uaugcuauguuagaagucc

SEQ ID NO: 2925 - RNA, 19 nt, Artificial Sequence
  Synthetic oligonucleotide
gcuauguuagaaguccagg

SEQ ID NO: 2926 - RNA, 19 nt, Artificial Sequence
  Synthetic oligonucleotide
uauguuagaaguccaggca

SEQ ID NO: 2927 - RNA, 19 nt, Artificial Sequence
  Synthetic oligonucleotide
auguuagaaguccaggcag

SEQ ID NO: 2928 - RNA, 19 nt, Artificial Sequence
  Synthetic oligonucleotide
uguuagaaguccaggcaga

SEQ ID NO: 2929 - RNA, 19 nt, Artificial Sequence
  Synthetic oligonucleotide
guuagaaguccaggcagag

SEQ ID NO: 2930 - RNA, 19 nt, Artificial Sequence
  Synthetic oligonucleotide
uuagaaguccaggcagaga

SEQ ID NO: 2931 - RNA, 19 nt, Artificial Sequence
  Synthetic oligonucleotide
uagaaguccaggcagagac

SEQ ID NO: 2932 - RNA, 19 nt, Artificial Sequence
  Synthetic oligonucleotide
agaaguccaggcagagaca

SEQ ID NO: 2933 - RNA, 19 nt, Artificial Sequence
  Synthetic oligonucleotide
gaaguccaggcagagacaa

SEQ ID NO: 2934 - RNA, 19 nt, Artificial Sequence
  Synthetic oligonucleotide
aaguccaggcagagacaau

SEQ ID NO: 2935 - RNA, 19 nt, Artificial Sequence
  Synthetic oligonucleotide
aguccaggcagagacaaua

SEQ ID NO: 2936 - RNA, 19 nt, Artificial Sequence
  Synthetic oligonucleotide
guccaggcagagacaauaa

SEQ ID NO: 2937 - RNA, 19 nt, Artificial Sequence
  Synthetic oligonucleotide
ccaggcagagacaauaaaa

SEQ ID NO: 2938 - RNA, 19 nt, Artificial Sequence
  Synthetic oligonucleotide
caggcagagacaauaaaac

SEQ ID NO: 2939 - RNA, 19 nt, Artificial Sequence
  Synthetic oligonucleotide
aggcagagacaauaaaaca

SEQ ID NO: 2940 - RNA, 19 nt, Artificial Sequence
  Synthetic oligonucleotide
ggcagagacaauaaaacau

SEQ ID NO: 2941 - RNA, 19 nt, Artificial Sequence
  Synthetic oligonucleotide
gcagagacaauaaaacauu

SEQ ID NO: 2942 - RNA, 19 nt, Artificial Sequence
  Synthetic oligonucleotide
cagagacaauaaaacauuc

SEQ ID NO: 2943 - RNA, 19 nt, Artificial Sequence
  Synthetic oligonucleotide
agagacaauaaaacauucc

SEQ ID NO: 2944 - RNA, 19 nt, Artificial Sequence
  Synthetic oligonucleotide
gagacaauaaaacauuccu

SEQ ID NO: 2945 - RNA, 19 nt, Artificial Sequence
  Synthetic oligonucleotide
agacaauaaaacauuccug

SEQ ID NO: 2946 - RNA, 19 nt, Artificial Sequence
  Synthetic oligonucleotide
gacaauaaaacauuccugu

SEQ ID NO: 2947 - RNA, 19 nt, Artificial Sequence
  Synthetic oligonucleotide
acaauaaaacauuccugug

SEQ ID NO: 2948 - RNA, 19 nt, Artificial Sequence
  Synthetic oligonucleotide
caauaaaacauuccuguga

SEQ ID NO: 2949 - RNA, 19 nt, Artificial Sequence
  Synthetic oligonucleotide
aauaaaacauuccugugaa

SEQ ID NO: 2950 - RNA, 19 nt, Artificial Sequence
  Synthetic oligonucleotide
aaaacauuccugugaaagg

SEQ ID NO: 2951 - RNA, 19 nt, Artificial Sequence
  Synthetic oligonucleotide
aaacauuccugugaaaggc

SEQ ID NO: 2952 - RNA, 19 nt, Artificial Sequence
  Synthetic oligonucleotide
aacauuccugugaaaggca

SEQ ID NO: 2953 - RNA, 19 nt, Artificial Sequence
  Synthetic oligonucleotide
acauuccugugaaaggcac

SEQ ID NO: 2954 - RNA, 19 nt, Artificial Sequence
  Synthetic oligonucleotide
cauuccugugaaaggcacu

SEQ ID NO: 2955 - RNA, 19 nt, Artificial Sequence
  Synthetic oligonucleotide
auuccugugaaaggcacuu

SEQ ID NO: 2956 - RNA, 19 nt, Artificial Sequence
  Synthetic oligonucleotide
uccugugaaaggcacuuuu

SEQ ID NO: 2957 - RNA, 19 nt, Artificial Sequence
  Synthetic oligonucleotide
ccugugaaaggcacuuuuc

SEQ ID NO: 2958 - RNA, 19 nt, Artificial Sequence
  Synthetic oligonucleotide
cugugaaaggcacuuuuca

SEQ ID NO: 2959 - RNA, 19 nt, Artificial Sequence
  Synthetic oligonucleotide
ugugaaaggcacuuuucau

SEQ ID NO: 2960 - RNA, 19 nt, Artificial Sequence
  Synthetic oligonucleotide
gugaaaggcacuuuucauu

SEQ ID NO: 2961 - RNA, 19 nt, Artificial Sequence
  Synthetic oligonucleotide
ugaaaggcacuuuucauuc

SEQ ID NO: 2962 - RNA, 19 nt, Artificial Sequence
  Synthetic oligonucleotide
gaaaggcacuuuucauucc

SEQ ID NO: 2963 - RNA, 19 nt, Artificial Sequence
  Synthetic oligonucleotide
aaaggcacuuuucauucca

SEQ ID NO: 2964 - RNA, 19 nt, Artificial Sequence
  Synthetic oligonucleotide
aaggcacuuuucauuccac

SEQ ID NO: 2965 - RNA, 19 nt, Artificial Sequence
  Synthetic oligonucleotide
aggcacuuuucauuccacu

SEQ ID NO: 2966 - RNA, 19 nt, Artificial Sequence
  Synthetic oligonucleotide
ggcacuuuucauuccacuu

SEQ ID NO: 2967 - RNA, 19 nt, Artificial Sequence
  Synthetic oligonucleotide
gcacuuuucauuccacuuu

SEQ ID NO: 2968 - RNA, 19 nt, Artificial Sequence
  Synthetic oligonucleotide
cacuuuucauuccacuuua

SEQ ID NO: 2969 - RNA, 19 nt, Artificial Sequence
  Synthetic oligonucleotide
acuuuucauuccacuuuaa

SEQ ID NO: 2970 - RNA, 19 nt, Artificial Sequence
  Synthetic oligonucleotide
cuuuucauuccacuuuaac

SEQ ID NO: 2971 - RNA, 19 nt, Artificial Sequence
  Synthetic oligonucleotide
uuuucauuccacuuuaacu

SEQ ID NO: 2972 - RNA, 19 nt, Artificial Sequence
  Synthetic oligonucleotide
uuucauuccacuuuaacuu

SEQ ID NO: 2973 - RNA, 19 nt, Artificial Sequence
  Synthetic oligonucleotide
uucauuccacuuuaacuug

SEQ ID NO: 2974 - RNA, 19 nt, Artificial Sequence
  Synthetic oligonucleotide
ucauuccacuuuaacuuga

SEQ ID NO: 2975 - RNA, 19 nt, Artificial Sequence
  Synthetic oligonucleotide
cauuccacuuuaacuugau

SEQ ID NO: 2976 - RNA, 19 nt, Artificial Sequence
  Synthetic oligonucleotide
auuccacuuuaacuugauu

SEQ ID NO: 2977 - RNA, 19 nt, Artificial Sequence
  Synthetic oligonucleotide
uuccacuuuaacuugauuu

SEQ ID NO: 2978 - RNA, 19 nt, Artificial Sequence
  Synthetic oligonucleotide
uccacuuuaacuugauuuu

SEQ ID NO: 2979 - RNA, 19 nt, Artificial Sequence
  Synthetic oligonucleotide
ccacuuuaacuugauuuuu

SEQ ID NO: 2980 - RNA, 19 nt, Artificial Sequence
  Synthetic oligonucleotide
cacuuuaacuugauuuuuu

SEQ ID NO: 2981 - RNA, 19 nt, Artificial Sequence
  Synthetic oligonucleotide
acuuuaacuugauuuuuua

SEQ ID NO: 2982 - RNA, 19 nt, Artificial Sequence
  Synthetic oligonucleotide
cuuuaacuugauuuuuuaa

SEQ ID NO: 2983 - RNA, 19 nt, Artificial Sequence
  Synthetic oligonucleotide
uuuaacuugauuuuuuaaa

SEQ ID NO: 2984 - RNA, 19 nt, Artificial Sequence
  Synthetic oligonucleotide
uuaacuugauuuuuuaaau

SEQ ID NO: 2985 - RNA, 19 nt, Artificial Sequence
  Synthetic oligonucleotide
uaacuugauuuuuuaaauu

SEQ ID NO: 2986 - RNA, 19 nt, Artificial Sequence
  Synthetic oligonucleotide
aacuugauuuuuuaaauuc

SEQ ID NO: 2987 - RNA, 19 nt, Artificial Sequence
  Synthetic oligonucleotide
acuugauuuuuuaaauucc

SEQ ID NO: 2988 - RNA, 19 nt, Artificial Sequence
  Synthetic oligonucleotide
cuugauuuuuuaaauuccc

SEQ ID NO: 2989 - RNA, 19 nt, Artificial Sequence
  Synthetic oligonucleotide
uugauuuuuuaaauucccu

SEQ ID NO: 2990 - RNA, 19 nt, Artificial Sequence
  Synthetic oligonucleotide
ugauuuuuuaaauucccuu

SEQ ID NO: 2991 - RNA, 19 nt, Artificial Sequence
  Synthetic oligonucleotide
gauuuuuuaaauucccuua

SEQ ID NO: 2992 - RNA, 19 nt, Artificial Sequence
  Synthetic oligonucleotide
uuuuuuaaauucccuuauu

SEQ ID NO: 2993 - RNA, 19 nt, Artificial Sequence
  Synthetic oligonucleotide
uaaauucccuuauuguccc

SEQ ID NO: 2994 - RNA, 19 nt, Artificial Sequence
  Synthetic oligonucleotide
aaauucccuuauugucccu

SEQ ID NO: 2995 - RNA, 19 nt, Artificial Sequence
  Synthetic oligonucleotide
uucccuuauugucccuucc

SEQ ID NO: 2996 - RNA, 19 nt, Artificial Sequence
  Synthetic oligonucleotide
aaaaaagagaaucaaaauu

SEQ ID NO: 2997 - RNA, 19 nt, Artificial Sequence
  Synthetic oligonucleotide
aaaaagagaaucaaaauuu

SEQ ID NO: 2998 - RNA, 19 nt, Artificial Sequence
  Synthetic oligonucleotide
aaaagagaaucaaaauuuu

SEQ ID NO: 2999 - RNA, 19 nt, Artificial Sequence
  Synthetic oligonucleotide
aaagagaaucaaaauuuua

SEQ ID NO: 3000 - RNA, 19 nt, Artificial Sequence
  Synthetic oligonucleotide
aagagaaucaaaauuuuac

SEQ ID NO: 3001 - RNA, 19 nt, Artificial Sequence
  Synthetic oligonucleotide
agagaaucaaaauuuuaca

SEQ ID NO: 3002 - RNA, 19 nt, Artificial Sequence
  Synthetic oligonucleotide
gagaaucaaaauuuuacaa

SEQ ID NO: 3003 - RNA, 19 nt, Artificial Sequence
  Synthetic oligonucleotide
agaaucaaaauuuuacaaa

SEQ ID NO: 3004 - RNA, 19 nt, Artificial Sequence
  Synthetic oligonucleotide
gaaucaaaauuuuacaaag

SEQ ID NO: 3005 - RNA, 19 nt, Artificial Sequence
  Synthetic oligonucleotide
aaucaaaauuuuacaaaga

SEQ ID NO: 3006 - RNA, 19 nt, Artificial Sequence
  Synthetic oligonucleotide
aucaaaauuuuacaaagaa

SEQ ID NO: 3007 - RNA, 19 nt, Artificial Sequence
  Synthetic oligonucleotide
ucaaaauuuuacaaagaau

SEQ ID NO: 3008 - RNA, 19 nt, Artificial Sequence
  Synthetic oligonucleotide
caaaauuuuacaaagaauc

SEQ ID NO: 3009 - RNA, 19 nt, Artificial Sequence
  Synthetic oligonucleotide
aaaauuuuacaaagaauca

SEQ ID NO: 3010 - RNA, 19 nt, Artificial Sequence
  Synthetic oligonucleotide
aaauuuuacaaagaaucaa

SEQ ID NO: 3011 - RNA, 19 nt, Artificial Sequence
  Synthetic oligonucleotide
auuuuacaaagaaucaaag

SEQ ID NO: 3012 - RNA, 19 nt, Artificial Sequence
  Synthetic oligonucleotide
uuuuacaaagaaucaaagg

SEQ ID NO: 3013 - RNA, 19 nt, Artificial Sequence
  Synthetic oligonucleotide
uuuacaaagaaucaaagga

SEQ ID NO: 3014 - RNA, 19 nt, Artificial Sequence
  Synthetic oligonucleotide
uuacaaagaaucaaaggaa

SEQ ID NO: 3015 - RNA, 19 nt, Artificial Sequence
  Synthetic oligonucleotide
uacaaagaaucaaaggaau

SEQ ID NO: 3016 - RNA, 19 nt, Artificial Sequence
  Synthetic oligonucleotide
acaaagaaucaaaggaauu

SEQ ID NO: 3017 - RNA, 19 nt, Artificial Sequence
  Synthetic oligonucleotide
caaagaaucaaaggaauuc

SEQ ID NO: 3018 - RNA, 19 nt, Artificial Sequence
  Synthetic oligonucleotide
aaagaaucaaaggaauucu

SEQ ID NO: 3019 - RNA, 19 nt, Artificial Sequence
  Synthetic oligonucleotide
aagaaucaaaggaauucua

SEQ ID NO: 3020 - RNA, 19 nt, Artificial Sequence
  Synthetic oligonucleotide
agaaucaaaggaauucuag

SEQ ID NO: 3021 - RNA, 19 nt, Artificial Sequence
  Synthetic oligonucleotide
gaaucaaaggaauucuaga

SEQ ID NO: 3022 - RNA, 19 nt, Artificial Sequence
  Synthetic oligonucleotide
aaucaaaggaauucuagaa

SEQ ID NO: 3023 - RNA, 19 nt, Artificial Sequence
  Synthetic oligonucleotide
aucaaaggaauucuagaaa

SEQ ID NO: 3024 - RNA, 19 nt, Artificial Sequence
  Synthetic oligonucleotide
ucaaaggaauucuagaaag

SEQ ID NO: 3025 - RNA, 19 nt, Artificial Sequence
  Synthetic oligonucleotide
caaaggaauucuagaaagu

SEQ ID NO: 3026 - RNA, 19 nt, Artificial Sequence
  Synthetic oligonucleotide
uaggagagauccaaauuuc

SEQ ID NO: 3027 - RNA, 19 nt, Artificial Sequence
  Synthetic oligonucleotide
aggagagauccaaauuucc

SEQ ID NO: 3028 - RNA, 19 nt, Artificial Sequence
  Synthetic oligonucleotide
agagauccaaauuuccauu

SEQ ID NO: 3029 - RNA, 19 nt, Artificial Sequence
  Synthetic oligonucleotide
gagauccaaauuuccauug

SEQ ID NO: 3030 - RNA, 19 nt, Artificial Sequence
  Synthetic oligonucleotide
agauccaaauuuccauugu

SEQ ID NO: 3031 - RNA, 19 nt, Artificial Sequence
  Synthetic oligonucleotide
gauccaaauuuccauuguc

SEQ ID NO: 3032 - RNA, 19 nt, Artificial Sequence
  Synthetic oligonucleotide
auccaaauuuccauugucu

SEQ ID NO: 3033 - RNA, 19 nt, Artificial Sequence
  Synthetic oligonucleotide
uccaaauuuccauugucuu

SEQ ID NO: 3034 - RNA, 19 nt, Artificial Sequence
  Synthetic oligonucleotide
ccaaauuuccauugucuug

SEQ ID NO: 3035 - RNA, 19 nt, Artificial Sequence
  Synthetic oligonucleotide
caaauuuccauugucuugc

SEQ ID NO: 3036 - RNA, 19 nt, Artificial Sequence
  Synthetic oligonucleotide
aaauuuccauugucuugca

SEQ ID NO: 3037 - RNA, 19 nt, Artificial Sequence
  Synthetic oligonucleotide
aauuuccauugucuugcaa

SEQ ID NO: 3038 - RNA, 19 nt, Artificial Sequence
  Synthetic oligonucleotide
auuuccauugucuugcaag

SEQ ID NO: 3039 - RNA, 19 nt, Artificial Sequence
  Synthetic oligonucleotide
uuuccauugucuugcaagc

SEQ ID NO: 3040 - RNA, 19 nt, Artificial Sequence
  Synthetic oligonucleotide
uuccauugucuugcaagca

SEQ ID NO: 3041 - RNA, 19 nt, Artificial Sequence
  Synthetic oligonucleotide
uccauugucuugcaagcaa

SEQ ID NO: 3042 - RNA, 19 nt, Artificial Sequence
  Synthetic oligonucleotide
ccauugucuugcaagcaaa

SEQ ID NO: 3043 - RNA, 19 nt, Artificial Sequence
  Synthetic oligonucleotide
cauugucuugcaagcaaag

SEQ ID NO: 3044 - RNA, 19 nt, Artificial Sequence
  Synthetic oligonucleotide
auugucuugcaagcaaagc

SEQ ID NO: 3045 - RNA, 19 nt, Artificial Sequence
  Synthetic oligonucleotide
uugucuugcaagcaaagca

SEQ ID NO: 3046 - RNA, 19 nt, Artificial Sequence
  Synthetic oligonucleotide
ugucuugcaagcaaagcac

SEQ ID NO: 3047 - RNA, 19 nt, Artificial Sequence
  Synthetic oligonucleotide
gucuugcaagcaaagcacg

SEQ ID NO: 3048 - RNA, 19 nt, Artificial Sequence
  Synthetic oligonucleotide
ucuugcaagcaaagcacgu

SEQ ID NO: 3049 - RNA, 19 nt, Artificial Sequence
  Synthetic oligonucleotide
cuugcaagcaaagcacgua

SEQ ID NO: 3050 - RNA, 19 nt, Artificial Sequence
  Synthetic oligonucleotide
uugcaagcaaagcacguau

SEQ ID NO: 3051 - RNA, 19 nt, Artificial Sequence
  Synthetic oligonucleotide
ugcaagcaaagcacguauu

SEQ ID NO: 3052 - RNA, 19 nt, Artificial Sequence
  Synthetic oligonucleotide
gcaagcaaagcacguauua

SEQ ID NO: 3053 - RNA, 19 nt, Artificial Sequence
  Synthetic oligonucleotide
caagcaaagcacguauuaa

SEQ ID NO: 3054 - RNA, 19 nt, Artificial Sequence
  Synthetic oligonucleotide
aagcaaagcacguauuaaa

SEQ ID NO: 3055 - RNA, 19 nt, Artificial Sequence
  Synthetic oligonucleotide
agcaaagcacguauuaaau

SEQ ID NO: 3056 - RNA, 19 nt, Artificial Sequence
  Synthetic oligonucleotide
gcaaagcacguauuaaaua

SEQ ID NO: 3057 - RNA, 19 nt, Artificial Sequence
  Synthetic oligonucleotide
caaagcacguauuaaauau

SEQ ID NO: 3058 - RNA, 19 nt, Artificial Sequence
  Synthetic oligonucleotide
aaagcacguauuaaauaug

SEQ ID NO: 3059 - RNA, 19 nt, Artificial Sequence
  Synthetic oligonucleotide
aagcacguauuaaauauga

SEQ ID NO: 3060 - RNA, 19 nt, Artificial Sequence
  Synthetic oligonucleotide
agcacguauuaaauaugau

SEQ ID NO: 3061 - RNA, 19 nt, Artificial Sequence
  Synthetic oligonucleotide
gcacguauuaaauaugauc

SEQ ID NO: 3062 - RNA, 19 nt, Artificial Sequence
  Synthetic oligonucleotide
acguauuaaauaugaucug

SEQ ID NO: 3063 - RNA, 19 nt, Artificial Sequence
  Synthetic oligonucleotide
cguauuaaauaugaucugc

SEQ ID NO: 3064 - RNA, 19 nt, Artificial Sequence
  Synthetic oligonucleotide
uauuaaauaugaucugcag

SEQ ID NO: 3065 - RNA, 19 nt, Artificial Sequence
  Synthetic oligonucleotide
auuaaauaugaucugcagc

SEQ ID NO: 3066 - RNA, 19 nt, Artificial Sequence
  Synthetic oligonucleotide
uuaaauaugaucugcagcc

SEQ ID NO: 3067 - RNA, 19 nt, Artificial Sequence
  Synthetic oligonucleotide
uaaauaugaucugcagcca

SEQ ID NO: 3068 - RNA, 19 nt, Artificial Sequence
  Synthetic oligonucleotide
aaauaugaucugcagccau

SEQ ID NO: 3069 - RNA, 19 nt, Artificial Sequence
  Synthetic oligonucleotide
aauaugaucugcagccauu

SEQ ID NO: 3070 - RNA, 19 nt, Artificial Sequence
  Synthetic oligonucleotide
auaugaucugcagccauua

SEQ ID NO: 3071 - RNA, 19 nt, Artificial Sequence
  Synthetic oligonucleotide
uaugaucugcagccauuaa

SEQ ID NO: 3072 - RNA, 19 nt, Artificial Sequence
  Synthetic oligonucleotide
augaucugcagccauuaaa

SEQ ID NO: 3073 - RNA, 19 nt, Artificial Sequence
  Synthetic oligonucleotide
guugacuaagucaauaauc

SEQ ID NO: 3074 - RNA, 19 nt, Artificial Sequence
  Synthetic oligonucleotide
uugacuaagucaauaauca

SEQ ID NO: 3075 - RNA, 19 nt, Artificial Sequence
  Synthetic oligonucleotide
ugacuaagucaauaaucag

SEQ ID NO: 3076 - RNA, 19 nt, Artificial Sequence
  Synthetic oligonucleotide
gacuaagucaauaaucaga

SEQ ID NO: 3077 - RNA, 19 nt, Artificial Sequence
  Synthetic oligonucleotide
acuaagucaauaaucagaa

SEQ ID NO: 3078 - RNA, 19 nt, Artificial Sequence
  Synthetic oligonucleotide
cuaagucaauaaucagaau

SEQ ID NO: 3079 - RNA, 19 nt, Artificial Sequence
  Synthetic oligonucleotide
uaagucaauaaucagaauc

SEQ ID NO: 3080 - RNA, 19 nt, Artificial Sequence
  Synthetic oligonucleotide
aagucaauaaucagaauca

SEQ ID NO: 3081 - RNA, 19 nt, Artificial Sequence
  Synthetic oligonucleotide
agucaauaaucagaaucag

SEQ ID NO: 3082 - RNA, 19 nt, Artificial Sequence
  Synthetic oligonucleotide
gucaauaaucagaaucagc

SEQ ID NO: 3083 - RNA, 19 nt, Artificial Sequence
  Synthetic oligonucleotide
ucaauaaucagaaucagca

SEQ ID NO: 3084 - RNA, 19 nt, Artificial Sequence
  Synthetic oligonucleotide
caauaaucagaaucagcag

SEQ ID NO: 3085 - RNA, 19 nt, Artificial Sequence
  Synthetic oligonucleotide
aauaaucagaaucagcagg

SEQ ID NO: 3086 - RNA, 19 nt, Artificial Sequence
  Synthetic oligonucleotide
auaaucagaaucagcaggu

SEQ ID NO: 3087 - RNA, 19 nt, Artificial Sequence
  Synthetic oligonucleotide
uaaucagaaucagcagguu

SEQ ID NO: 3088 - RNA, 19 nt, Artificial Sequence
  Synthetic oligonucleotide
aucagaaucagcagguuug

SEQ ID NO: 3089 - RNA, 19 nt, Artificial Sequence
  Synthetic oligonucleotide
ucagaaucagcagguuugc

SEQ ID NO: 3090 - RNA, 19 nt, Artificial Sequence
  Synthetic oligonucleotide
agaaucagcagguuugcag

SEQ ID NO: 3091 - RNA, 19 nt, Artificial Sequence
  Synthetic oligonucleotide
gaaucagcagguuugcagu

SEQ ID NO: 3092 - RNA, 19 nt, Artificial Sequence
  Synthetic oligonucleotide
uugcagucagauuggcagg

SEQ ID NO: 3093 - RNA, 19 nt, Artificial Sequence
  Synthetic oligonucleotide
cagccuagcucaggagaag

SEQ ID NO: 3094 - RNA, 19 nt, Artificial Sequence
  Synthetic oligonucleotide
ccuagcucaggagaaguga

SEQ ID NO: 3095 - RNA, 19 nt, Artificial Sequence
  Synthetic oligonucleotide
cuagcucaggagaagugag

SEQ ID NO: 3096 - RNA, 19 nt, Artificial Sequence
  Synthetic oligonucleotide
uagcucaggagaagugagu

SEQ ID NO: 3097 - RNA, 19 nt, Artificial Sequence
  Synthetic oligonucleotide
agcucaggagaagugagua

SEQ ID NO: 3098 - RNA, 19 nt, Artificial Sequence
  Synthetic oligonucleotide
cucaggagaagugaguaua

SEQ ID NO: 3099 - RNA, 19 nt, Artificial Sequence
  Synthetic oligonucleotide
gagcagccaucacagaagu

SEQ ID NO: 3100 - RNA, 19 nt, Artificial Sequence
  Synthetic oligonucleotide
agcagccaucacagaaguc

SEQ ID NO: 3101 - RNA, 19 nt, Artificial Sequence
  Synthetic oligonucleotide
gcagccaucacagaagucc

SEQ ID NO: 3102 - RNA, 19 nt, Artificial Sequence
  Synthetic oligonucleotide
cagccaucacagaagucca

SEQ ID NO: 3103 - RNA, 19 nt, Artificial Sequence
  Synthetic oligonucleotide
agccaucacagaaguccac

SEQ ID NO: 3104 - RNA, 19 nt, Artificial Sequence
  Synthetic oligonucleotide
gccaucacagaaguccacu

SEQ ID NO: 3105 - RNA, 19 nt, Artificial Sequence
  Synthetic oligonucleotide
ccaucacagaaguccacuc

SEQ ID NO: 3106 - RNA, 19 nt, Artificial Sequence
  Synthetic oligonucleotide
aucacagaaguccacucau

SEQ ID NO: 3107 - RNA, 19 nt, Artificial Sequence
  Synthetic oligonucleotide
ucacagaaguccacucauu

SEQ ID NO: 3108 - RNA, 19 nt, Artificial Sequence
  Synthetic oligonucleotide
cauucuuggcaggauggcu

SEQ ID NO: 3109 - RNA, 19 nt, Artificial Sequence
  Synthetic oligonucleotide
auucuuggcaggauggcuu

SEQ ID NO: 3110 - RNA, 19 nt, Artificial Sequence
  Synthetic oligonucleotide
uucuuggcaggauggcuuc

SEQ ID NO: 3111 - RNA, 19 nt, Artificial Sequence
  Synthetic oligonucleotide
ucuuggcaggauggcuucu

SEQ ID NO: 3112 - RNA, 19 nt, Artificial Sequence
  Synthetic oligonucleotide
cuuggcaggauggcuucuc

SEQ ID NO: 3113 - RNA, 19 nt, Artificial Sequence
  Synthetic oligonucleotide
uuggcaggauggcuucuca

SEQ ID NO: 3114 - RNA, 19 nt, Artificial Sequence
  Synthetic oligonucleotide
uggcaggauggcuucucau

SEQ ID NO: 3115 - RNA, 19 nt, Artificial Sequence
  Synthetic oligonucleotide
ggcaggauggcuucucauc

SEQ ID NO: 3116 - RNA, 19 nt, Artificial Sequence
  Synthetic oligonucleotide
gcaggauggcuucucaucg

SEQ ID NO: 3117 - RNA, 19 nt, Artificial Sequence
  Synthetic oligonucleotide
caggauggcuucucaucgu

SEQ ID NO: 3118 - RNA, 19 nt, Artificial Sequence
  Synthetic oligonucleotide
aggauggcuucucaucguc

SEQ ID NO: 3119 - RNA, 19 nt, Artificial Sequence
  Synthetic oligonucleotide
ggauggcuucucaucgucu

SEQ ID NO: 3120 - RNA, 19 nt, Artificial Sequence
  Synthetic oligonucleotide
gauggcuucucaucgucug

SEQ ID NO: 3121 - RNA, 19 nt, Artificial Sequence
  Synthetic oligonucleotide
auggcuucucaucgucugc

SEQ ID NO: 3122 - RNA, 19 nt, Artificial Sequence
  Synthetic oligonucleotide
uggcuucucaucgucugcu

SEQ ID NO: 3123 - RNA, 19 nt, Artificial Sequence
  Synthetic oligonucleotide
ggcuucucaucgucugcuc

SEQ ID NO: 3124 - RNA, 19 nt, Artificial Sequence
  Synthetic oligonucleotide
ccucugccuugcuggacug

SEQ ID NO: 3125 - RNA, 19 nt, Artificial Sequence
  Synthetic oligonucleotide
cucugccuugcuggacugg

SEQ ID NO: 3126 - RNA, 19 nt, Artificial Sequence
  Synthetic oligonucleotide
caccggugaauccaagugu

SEQ ID NO: 3127 - RNA, 19 nt, Artificial Sequence
  Synthetic oligonucleotide
ggugaauccaaguguccuc

SEQ ID NO: 3128 - RNA, 19 nt, Artificial Sequence
  Synthetic oligonucleotide
gugaauccaaguguccucu

SEQ ID NO: 3129 - RNA, 19 nt, Artificial Sequence
  Synthetic oligonucleotide
ugaauccaaguguccucug

SEQ ID NO: 3130 - RNA, 19 nt, Artificial Sequence
  Synthetic oligonucleotide
gaauccaaguguccucuga

SEQ ID NO: 3131 - RNA, 19 nt, Artificial Sequence
  Synthetic oligonucleotide
aauccaaguguccucugau

SEQ ID NO: 3132 - RNA, 19 nt, Artificial Sequence
  Synthetic oligonucleotide
auccaaguguccucugaug

SEQ ID NO: 3133 - RNA, 19 nt, Artificial Sequence
  Synthetic oligonucleotide
uccaaguguccucugaugg

SEQ ID NO: 3134 - RNA, 19 nt, Artificial Sequence
  Synthetic oligonucleotide
ccaaguguccucugauggu

SEQ ID NO: 3135 - RNA, 19 nt, Artificial Sequence
  Synthetic oligonucleotide
caaguguccucugaugguc

SEQ ID NO: 3136 - RNA, 19 nt, Artificial Sequence
  Synthetic oligonucleotide
aaguguccucugaugguca

SEQ ID NO: 3137 - RNA, 19 nt, Artificial Sequence
  Synthetic oligonucleotide
aguguccucugauggucaa

SEQ ID NO: 3138 - RNA, 19 nt, Artificial Sequence
  Synthetic oligonucleotide
guguccucugauggucaaa

SEQ ID NO: 3139 - RNA, 19 nt, Artificial Sequence
  Synthetic oligonucleotide
uguccucugauggucaaag

SEQ ID NO: 3140 - RNA, 19 nt, Artificial Sequence
  Synthetic oligonucleotide
guccucugauggucaaagu

SEQ ID NO: 3141 - RNA, 19 nt, Artificial Sequence
  Synthetic oligonucleotide
uccucugauggucaaaguu

SEQ ID NO: 3142 - RNA, 19 nt, Artificial Sequence
  Synthetic oligonucleotide
ccucugauggucaaaguuc

SEQ ID NO: 3143 - RNA, 19 nt, Artificial Sequence
  Synthetic oligonucleotide
cucugauggucaaaguucu

SEQ ID NO: 3144 - RNA, 19 nt, Artificial Sequence
  Synthetic oligonucleotide
ucugauggucaaaguucua

SEQ ID NO: 3145 - RNA, 19 nt, Artificial Sequence
  Synthetic oligonucleotide
cugauggucaaaguucuag

SEQ ID NO: 3146 - RNA, 19 nt, Artificial Sequence
  Synthetic oligonucleotide
ugauggucaaaguucuaga

SEQ ID NO: 3147 - RNA, 19 nt, Artificial Sequence
  Synthetic oligonucleotide
gauggucaaaguucuagau

SEQ ID NO: 3148 - RNA, 19 nt, Artificial Sequence
  Synthetic oligonucleotide
gagccauuugccucuggga

SEQ ID NO: 3149 - RNA, 19 nt, Artificial Sequence
  Synthetic oligonucleotide
agccauuugccucugggaa

SEQ ID NO: 3150 - RNA, 19 nt, Artificial Sequence
  Synthetic oligonucleotide
gccauuugccucugggaaa

SEQ ID NO: 3151 - RNA, 19 nt, Artificial Sequence
  Synthetic oligonucleotide
ccauuugccucugggaaaa

SEQ ID NO: 3152 - RNA, 19 nt, Artificial Sequence
  Synthetic oligonucleotide
cauuugccucugggaaaac

SEQ ID NO: 3153 - RNA, 19 nt, Artificial Sequence
  Synthetic oligonucleotide
auuugccucugggaaaacc

SEQ ID NO: 3154 - RNA, 19 nt, Artificial Sequence
  Synthetic oligonucleotide
uuugccucugggaaaacca

SEQ ID NO: 3155 - RNA, 19 nt, Artificial Sequence
  Synthetic oligonucleotide
uugccucugggaaaaccag

SEQ ID NO: 3156 - RNA, 19 nt, Artificial Sequence
  Synthetic oligonucleotide
ugccucugggaaaaccagu

SEQ ID NO: 3157 - RNA, 19 nt, Artificial Sequence
  Synthetic oligonucleotide
gccucugggaaaaccagug

SEQ ID NO: 3158 - RNA, 19 nt, Artificial Sequence
  Synthetic oligonucleotide
ccucugggaaaaccaguga

SEQ ID NO: 3159 - RNA, 19 nt, Artificial Sequence
  Synthetic oligonucleotide
cucugggaaaaccagugag

SEQ ID NO: 3160 - RNA, 19 nt, Artificial Sequence
  Synthetic oligonucleotide
ucugggaaaaccagugagu

SEQ ID NO: 3161 - RNA, 19 nt, Artificial Sequence
  Synthetic oligonucleotide
cugggaaaaccagugaguc

SEQ ID NO: 3162 - RNA, 19 nt, Artificial Sequence
  Synthetic oligonucleotide
ugggaaaaccagugagucu

SEQ ID NO: 3163 - RNA, 19 nt, Artificial Sequence
  Synthetic oligonucleotide
gggaaaaccagugagucug

SEQ ID NO: 3164 - RNA, 19 nt, Artificial Sequence
  Synthetic oligonucleotide
agagcugcaugggcucaca

SEQ ID NO: 3165 - RNA, 19 nt, Artificial Sequence
  Synthetic oligonucleotide
gagcugcaugggcucacaa

SEQ ID NO: 3166 - RNA, 19 nt, Artificial Sequence
  Synthetic oligonucleotide
agcugcaugggcucacaac

SEQ ID NO: 3167 - RNA, 19 nt, Artificial Sequence
  Synthetic oligonucleotide
gcugcaugggcucacaacu

SEQ ID NO: 3168 - RNA, 19 nt, Artificial Sequence
  Synthetic oligonucleotide
cugcaugggcucacaacug

SEQ ID NO: 3169 - RNA, 19 nt, Artificial Sequence
  Synthetic oligonucleotide
ugcaugggcucacaacuga

SEQ ID NO: 3170 - RNA, 19 nt, Artificial Sequence
  Synthetic oligonucleotide
gcaugggcucacaacugag

SEQ ID NO: 3171 - RNA, 19 nt, Artificial Sequence
  Synthetic oligonucleotide
caugggcucacaacugagg

SEQ ID NO: 3172 - RNA, 19 nt, Artificial Sequence
  Synthetic oligonucleotide
augggcucacaacugagga

SEQ ID NO: 3173 - RNA, 19 nt, Artificial Sequence
  Synthetic oligonucleotide
ugggcucacaacugaggag

SEQ ID NO: 3174 - RNA, 19 nt, Artificial Sequence
  Synthetic oligonucleotide
gggcucacaacugaggagg

SEQ ID NO: 3175 - RNA, 19 nt, Artificial Sequence
  Synthetic oligonucleotide
ggcucacaacugaggagga

SEQ ID NO: 3176 - RNA, 19 nt, Artificial Sequence
  Synthetic oligonucleotide
gcucacaacugaggaggaa

SEQ ID NO: 3177 - RNA, 19 nt, Artificial Sequence
  Synthetic oligonucleotide
cucacaacugaggaggaau

SEQ ID NO: 3178 - RNA, 19 nt, Artificial Sequence
  Synthetic oligonucleotide
ucacaacugaggaggaauu

SEQ ID NO: 3179 - RNA, 19 nt, Artificial Sequence
  Synthetic oligonucleotide
cacaacugaggaggaauuu

SEQ ID NO: 3180 - RNA, 19 nt, Artificial Sequence
  Synthetic oligonucleotide
caacugaggaggaauuugu

SEQ ID NO: 3181 - RNA, 19 nt, Artificial Sequence
  Synthetic oligonucleotide
aacugaggaggaauuugua

SEQ ID NO: 3182 - RNA, 19 nt, Artificial Sequence
  Synthetic oligonucleotide
acugaggaggaauuuguag

SEQ ID NO: 3183 - RNA, 19 nt, Artificial Sequence
  Synthetic oligonucleotide
cugaggaggaauuuguaga

SEQ ID NO: 3184 - RNA, 19 nt, Artificial Sequence
  Synthetic oligonucleotide
ugaggaggaauuuguagaa

SEQ ID NO: 3185 - RNA, 19 nt, Artificial Sequence
  Synthetic oligonucleotide
gaggaggaauuuguagaag

SEQ ID NO: 3186 - RNA, 19 nt, Artificial Sequence
  Synthetic oligonucleotide
aggaggaauuuguagaagg

SEQ ID NO: 3187 - RNA, 19 nt, Artificial Sequence
  Synthetic oligonucleotide
ggaggaauuuguagaaggg

SEQ ID NO: 3188 - RNA, 19 nt, Artificial Sequence
  Synthetic oligonucleotide
gaggaauuuguagaaggga

SEQ ID NO: 3189 - RNA, 19 nt, Artificial Sequence
  Synthetic oligonucleotide
aggaauuuguagaagggau

SEQ ID NO: 3190 - RNA, 19 nt, Artificial Sequence
  Synthetic oligonucleotide
ggaauuuguagaagggaua

SEQ ID NO: 3191 - RNA, 19 nt, Artificial Sequence
  Synthetic oligonucleotide
gaauuuguagaagggauau

SEQ ID NO: 3192 - RNA, 19 nt, Artificial Sequence
  Synthetic oligonucleotide
aauuuguagaagggauaua

SEQ ID NO: 3193 - RNA, 19 nt, Artificial Sequence
  Synthetic oligonucleotide
auuuguagaagggauauac

SEQ ID NO: 3194 - RNA, 19 nt, Artificial Sequence
  Synthetic oligonucleotide
uuuguagaagggauauaca

SEQ ID NO: 3195 - RNA, 19 nt, Artificial Sequence
  Synthetic oligonucleotide
uuguagaagggauauacaa

SEQ ID NO: 3196 - RNA, 19 nt, Artificial Sequence
  Synthetic oligonucleotide
uguagaagggauauacaaa

SEQ ID NO: 3197 - RNA, 19 nt, Artificial Sequence
  Synthetic oligonucleotide
guagaagggauauacaaag

SEQ ID NO: 3198 - RNA, 19 nt, Artificial Sequence
  Synthetic oligonucleotide
uagaagggauauacaaagu

SEQ ID NO: 3199 - RNA, 19 nt, Artificial Sequence
  Synthetic oligonucleotide
agaagggauauacaaagug

SEQ ID NO: 3200 - RNA, 19 nt, Artificial Sequence
  Synthetic oligonucleotide
gaagggauauacaaagugg

SEQ ID NO: 3201 - RNA, 19 nt, Artificial Sequence
  Synthetic oligonucleotide
aagggauauacaaagugga

SEQ ID NO: 3202 - RNA, 19 nt, Artificial Sequence
  Synthetic oligonucleotide
agggauauacaaaguggaa

SEQ ID NO: 3203 - RNA, 19 nt, Artificial Sequence
  Synthetic oligonucleotide
gggauauacaaaguggaaa

SEQ ID NO: 3204 - RNA, 19 nt, Artificial Sequence
  Synthetic oligonucleotide
ggauauacaaaguggaaau

SEQ ID NO: 3205 - RNA, 19 nt, Artificial Sequence
  Synthetic oligonucleotide
gauauacaaaguggaaaua

SEQ ID NO: 3206 - RNA, 19 nt, Artificial Sequence
  Synthetic oligonucleotide
auauacaaaguggaaauag

SEQ ID NO: 3207 - RNA, 19 nt, Artificial Sequence
  Synthetic oligonucleotide
uauacaaaguggaaauaga

SEQ ID NO: 3208 - RNA, 19 nt, Artificial Sequence
  Synthetic oligonucleotide
auacaaaguggaaauagac

SEQ ID NO: 3209 - RNA, 19 nt, Artificial Sequence
  Synthetic oligonucleotide
uacaaaguggaaauagaca

SEQ ID NO: 3210 - RNA, 19 nt, Artificial Sequence
  Synthetic oligonucleotide
acaaaguggaaauagacac

SEQ ID NO: 3211 - RNA, 19 nt, Artificial Sequence
  Synthetic oligonucleotide
caaaguggaaauagacacc

SEQ ID NO: 3212 - RNA, 19 nt, Artificial Sequence
  Synthetic oligonucleotide
aaaguggaaauagacacca

SEQ ID NO: 3213 - RNA, 19 nt, Artificial Sequence
  Synthetic oligonucleotide
aaguggaaauagacaccaa

SEQ ID NO: 3214 - RNA, 19 nt, Artificial Sequence
  Synthetic oligonucleotide
aguggaaauagacaccaaa

SEQ ID NO: 3215 - RNA, 19 nt, Artificial Sequence
  Synthetic oligonucleotide
guggaaauagacaccaaau

SEQ ID NO: 3216 - RNA, 19 nt, Artificial Sequence
  Synthetic oligonucleotide
uggaaauagacaccaaauc

SEQ ID NO: 3217 - RNA, 19 nt, Artificial Sequence
  Synthetic oligonucleotide
ggaaauagacaccaaaucu

SEQ ID NO: 3218 - RNA, 19 nt, Artificial Sequence
  Synthetic oligonucleotide
gaaauagacaccaaaucuu

SEQ ID NO: 3219 - RNA, 19 nt, Artificial Sequence
  Synthetic oligonucleotide
aaauagacaccaaaucuua

SEQ ID NO: 3220 - RNA, 19 nt, Artificial Sequence
  Synthetic oligonucleotide
auagacaccaaaucuuacu

SEQ ID NO: 3221 - RNA, 19 nt, Artificial Sequence
  Synthetic oligonucleotide
uagacaccaaaucuuacug

SEQ ID NO: 3222 - RNA, 19 nt, Artificial Sequence
  Synthetic oligonucleotide
ggcacuuggcaucucccca

SEQ ID NO: 3223 - RNA, 19 nt, Artificial Sequence
  Synthetic oligonucleotide
gcacuuggcaucuccccau

SEQ ID NO: 3224 - RNA, 19 nt, Artificial Sequence
  Synthetic oligonucleotide
cacuuggcaucuccccauu

SEQ ID NO: 3225 - RNA, 19 nt, Artificial Sequence
  Synthetic oligonucleotide
acuuggcaucuccccauuc

SEQ ID NO: 3226 - RNA, 19 nt, Artificial Sequence
  Synthetic oligonucleotide
cuuggcaucuccccauucc

SEQ ID NO: 3227 - RNA, 19 nt, Artificial Sequence
  Synthetic oligonucleotide
uuggcaucuccccauucca

SEQ ID NO: 3228 - RNA, 19 nt, Artificial Sequence
  Synthetic oligonucleotide
uggcaucuccccauuccau

SEQ ID NO: 3229 - RNA, 19 nt, Artificial Sequence
  Synthetic oligonucleotide
ggcaucuccccauuccaug

SEQ ID NO: 3230 - RNA, 19 nt, Artificial Sequence
  Synthetic oligonucleotide
gcaucuccccauuccauga

SEQ ID NO: 3231 - RNA, 19 nt, Artificial Sequence
  Synthetic oligonucleotide
caucuccccauuccaugag

SEQ ID NO: 3232 - RNA, 19 nt, Artificial Sequence
  Synthetic oligonucleotide
aucuccccauuccaugagc

SEQ ID NO: 3233 - RNA, 19 nt, Artificial Sequence
  Synthetic oligonucleotide
ucuccccauuccaugagca

SEQ ID NO: 3234 - RNA, 19 nt, Artificial Sequence
  Synthetic oligonucleotide
cuccccauuccaugagcau

SEQ ID NO: 3235 - RNA, 19 nt, Artificial Sequence
  Synthetic oligonucleotide
uccaugagcaugcagaggu

SEQ ID NO: 3236 - RNA, 19 nt, Artificial Sequence
  Synthetic oligonucleotide
ccaugagcaugcagaggug

SEQ ID NO: 3237 - RNA, 19 nt, Artificial Sequence
  Synthetic oligonucleotide
caugagcaugcagaggugg

SEQ ID NO: 3238 - RNA, 19 nt, Artificial Sequence
  Synthetic oligonucleotide
augagcaugcagagguggu

SEQ ID NO: 3239 - RNA, 19 nt, Artificial Sequence
  Synthetic oligonucleotide
gcaugcagaggugguauuc

SEQ ID NO: 3240 - RNA, 19 nt, Artificial Sequence
  Synthetic oligonucleotide
gcagaggugguauucacag

SEQ ID NO: 3241 - RNA, 19 nt, Artificial Sequence
  Synthetic oligonucleotide
cagaggugguauucacagc

SEQ ID NO: 3242 - RNA, 19 nt, Artificial Sequence
  Synthetic oligonucleotide
cugucgucaccaaucccaa

SEQ ID NO: 3243 - RNA, 19 nt, Artificial Sequence
  Synthetic oligonucleotide
aaggacgagggaugggauu

SEQ ID NO: 3244 - RNA, 19 nt, Artificial Sequence
  Synthetic oligonucleotide
aggacgagggaugggauuu

SEQ ID NO: 3245 - RNA, 19 nt, Artificial Sequence
  Synthetic oligonucleotide
acgagggaugggauuucau

SEQ ID NO: 3246 - RNA, 19 nt, Artificial Sequence
  Synthetic oligonucleotide
cgagggaugggauuucaug

SEQ ID NO: 3247 - RNA, 19 nt, Artificial Sequence
  Synthetic oligonucleotide
gagggaugggauuucaugu

SEQ ID NO: 3248 - RNA, 19 nt, Artificial Sequence
  Synthetic oligonucleotide
gggaugggauuucauguaa

SEQ ID NO: 3249 - RNA, 19 nt, Artificial Sequence
  Synthetic oligonucleotide
ggaugggauuucauguaac

SEQ ID NO: 3250 - RNA, 19 nt, Artificial Sequence
  Synthetic oligonucleotide
gaugggauuucauguaacc

SEQ ID NO: 3251 - RNA, 19 nt, Artificial Sequence
  Synthetic oligonucleotide
augggauuucauguaacca

SEQ ID NO: 3252 - RNA, 19 nt, Artificial Sequence
  Synthetic oligonucleotide
ugggauuucauguaaccaa

SEQ ID NO: 3253 - RNA, 19 nt, Artificial Sequence
  Synthetic oligonucleotide
gggauuucauguaaccaag

SEQ ID NO: 3254 - RNA, 19 nt, Artificial Sequence
  Synthetic oligonucleotide
ggauuucauguaaccaaga

SEQ ID NO: 3255 - RNA, 19 nt, Artificial Sequence
  Synthetic oligonucleotide
gauuucauguaaccaagag

SEQ ID NO: 3256 - RNA, 19 nt, Artificial Sequence
  Synthetic oligonucleotide
auuucauguaaccaagagu

SEQ ID NO: 3257 - RNA, 19 nt, Artificial Sequence
  Synthetic oligonucleotide
uuucauguaaccaagagua

SEQ ID NO: 3258 - RNA, 19 nt, Artificial Sequence
  Synthetic oligonucleotide
uucauguaaccaagaguau

SEQ ID NO: 3259 - RNA, 19 nt, Artificial Sequence
  Synthetic oligonucleotide
ucauguaaccaagaguauu

SEQ ID NO: 3260 - RNA, 19 nt, Artificial Sequence
  Synthetic oligonucleotide
cauguaaccaagaguauuc

SEQ ID NO: 3261 - RNA, 19 nt, Artificial Sequence
  Synthetic oligonucleotide
auguaaccaagaguauucc

SEQ ID NO: 3262 - RNA, 19 nt, Artificial Sequence
  Synthetic oligonucleotide
uguaaccaagaguauucca

SEQ ID NO: 3263 - RNA, 19 nt, Artificial Sequence
  Synthetic oligonucleotide
guaaccaagaguauuccau

SEQ ID NO: 3264 - RNA, 19 nt, Artificial Sequence
  Synthetic oligonucleotide
uaaccaagaguauuccauu

SEQ ID NO: 3265 - RNA, 19 nt, Artificial Sequence
  Synthetic oligonucleotide
aaccaagaguauuccauuu

SEQ ID NO: 3266 - RNA, 19 nt, Artificial Sequence
  Synthetic oligonucleotide
accaagaguauuccauuuu

SEQ ID NO: 3267 - RNA, 19 nt, Artificial Sequence
  Synthetic oligonucleotide
ccaagaguauuccauuuuu

SEQ ID NO: 3268 - RNA, 19 nt, Artificial Sequence
  Synthetic oligonucleotide
caagaguauuccauuuuua

SEQ ID NO: 3269 - RNA, 19 nt, Artificial Sequence
  Synthetic oligonucleotide
aagaguauuccauuuuuac

SEQ ID NO: 3270 - RNA, 19 nt, Artificial Sequence
  Synthetic oligonucleotide
agaguauuccauuuuuacu

SEQ ID NO: 3271 - RNA, 19 nt, Artificial Sequence
  Synthetic oligonucleotide
gaguauuccauuuuuacua

SEQ ID NO: 3272 - RNA, 19 nt, Artificial Sequence
  Synthetic oligonucleotide
aguauuccauuuuuacuaa

SEQ ID NO: 3273 - RNA, 19 nt, Artificial Sequence
  Synthetic oligonucleotide
guauuccauuuuuacuaaa

SEQ ID NO: 3274 - RNA, 19 nt, Artificial Sequence
  Synthetic oligonucleotide
uauuccauuuuuacuaaag

SEQ ID NO: 3275 - RNA, 19 nt, Artificial Sequence
  Synthetic oligonucleotide
auuccauuuuuacuaaagc

SEQ ID NO: 3276 - RNA, 19 nt, Artificial Sequence
  Synthetic oligonucleotide
uuccauuuuuacuaaagca

SEQ ID NO: 3277 - RNA, 19 nt, Artificial Sequence
  Synthetic oligonucleotide
uccauuuuuacuaaagcag

SEQ ID NO: 3278 - RNA, 19 nt, Artificial Sequence
  Synthetic oligonucleotide
ccauuuuuacuaaagcagu

SEQ ID NO: 3279 - RNA, 19 nt, Artificial Sequence
  Synthetic oligonucleotide
cauuuuuacuaaagcagug

SEQ ID NO: 3280 - RNA, 19 nt, Artificial Sequence
  Synthetic oligonucleotide
auuuuuacuaaagcagugu

SEQ ID NO: 3281 - RNA, 19 nt, Artificial Sequence
  Synthetic oligonucleotide
uuuuuacuaaagcaguguu

SEQ ID NO: 3282 - RNA, 19 nt, Artificial Sequence
  Synthetic oligonucleotide
uuuuacuaaagcaguguuu

SEQ ID NO: 3283 - RNA, 19 nt, Artificial Sequence
  Synthetic oligonucleotide
uuuacuaaagcaguguuuu

SEQ ID NO: 3284 - RNA, 19 nt, Artificial Sequence
  Synthetic oligonucleotide
uuacuaaagcaguguuuuc

SEQ ID NO: 3285 - RNA, 19 nt, Artificial Sequence
  Synthetic oligonucleotide
uacuaaagcaguguuuuca

SEQ ID NO: 3286 - RNA, 19 nt, Artificial Sequence
  Synthetic oligonucleotide
acuaaagcaguguuuucac

SEQ ID NO: 3287 - RNA, 19 nt, Artificial Sequence
  Synthetic oligonucleotide
cuaaagcaguguuuucacc

SEQ ID NO: 3288 - RNA, 19 nt, Artificial Sequence
  Synthetic oligonucleotide
uaaagcaguguuuucaccu

SEQ ID NO: 3289 - RNA, 19 nt, Artificial Sequence
  Synthetic oligonucleotide
aaagcaguguuuucaccuc

SEQ ID NO: 3290 - RNA, 19 nt, Artificial Sequence
  Synthetic oligonucleotide
aagcaguguuuucaccuca

SEQ ID NO: 3291 - RNA, 19 nt, Artificial Sequence
  Synthetic oligonucleotide
agcaguguuuucaccucau

SEQ ID NO: 3292 - RNA, 19 nt, Artificial Sequence
  Synthetic oligonucleotide
gcaguguuuucaccucaua

SEQ ID NO: 3293 - RNA, 19 nt, Artificial Sequence
  Synthetic oligonucleotide
caguguuuucaccucauau

SEQ ID NO: 3294 - RNA, 19 nt, Artificial Sequence
  Synthetic oligonucleotide
aguguuuucaccucauaug

SEQ ID NO: 3295 - RNA, 19 nt, Artificial Sequence
  Synthetic oligonucleotide
guguuuucaccucauaugc

SEQ ID NO: 3296 - RNA, 19 nt, Artificial Sequence
  Synthetic oligonucleotide
uguuuucaccucauaugcu

SEQ ID NO: 3297 - RNA, 19 nt, Artificial Sequence
  Synthetic oligonucleotide
guuuucaccucauaugcua

SEQ ID NO: 3298 - RNA, 19 nt, Artificial Sequence
  Synthetic oligonucleotide
uuuucaccucauaugcuau

SEQ ID NO: 3299 - RNA, 19 nt, Artificial Sequence
  Synthetic oligonucleotide
uuucaccucauaugcuaug

SEQ ID NO: 3300 - RNA, 19 nt, Artificial Sequence
  Synthetic oligonucleotide
uucaccucauaugcuaugu

SEQ ID NO: 3301 - RNA, 19 nt, Artificial Sequence
  Synthetic oligonucleotide
ucaccucauaugcuauguu

SEQ ID NO: 3302 - RNA, 19 nt, Artificial Sequence
  Synthetic oligonucleotide
caccucauaugcuauguua

SEQ ID NO: 3303 - RNA, 19 nt, Artificial Sequence
  Synthetic oligonucleotide
accucauaugcuauguuag

SEQ ID NO: 3304 - RNA, 19 nt, Artificial Sequence
  Synthetic oligonucleotide
ccucauaugcuauguuaga

SEQ ID NO: 3305 - RNA, 19 nt, Artificial Sequence
  Synthetic oligonucleotide
cucauaugcuauguuagaa

SEQ ID NO: 3306 - RNA, 19 nt, Artificial Sequence
  Synthetic oligonucleotide
ucauaugcuauguuagaag

SEQ ID NO: 3307 - RNA, 19 nt, Artificial Sequence
  Synthetic oligonucleotide
cauaugcuauguuagaagu

SEQ ID NO: 3308 - RNA, 19 nt, Artificial Sequence
  Synthetic oligonucleotide
auaugcuauguuagaaguc

SEQ ID NO: 3309 - RNA, 19 nt, Artificial Sequence
  Synthetic oligonucleotide
ugcuauguuagaaguccag

SEQ ID NO: 3310 - RNA, 19 nt, Artificial Sequence
  Synthetic oligonucleotide
cuauguuagaaguccaggc

SEQ ID NO: 3311 - RNA, 19 nt, Artificial Sequence
  Synthetic oligonucleotide
uauguuagaaguccaggca

SEQ ID NO: 3312 - RNA, 19 nt, Artificial Sequence
  Synthetic oligonucleotide
auguuagaaguccaggcag

SEQ ID NO: 3313 - RNA, 19 nt, Artificial Sequence
  Synthetic oligonucleotide
uguuagaaguccaggcaga

SEQ ID NO: 3314 - RNA, 19 nt, Artificial Sequence
  Synthetic oligonucleotide
guuagaaguccaggcagag

SEQ ID NO: 3315 - RNA, 19 nt, Artificial Sequence
  Synthetic oligonucleotide
uuagaaguccaggcagaga

SEQ ID NO: 3316 - RNA, 19 nt, Artificial Sequence
  Synthetic oligonucleotide
uagaaguccaggcagagac

SEQ ID NO: 3317 - RNA, 19 nt, Artificial Sequence
  Synthetic oligonucleotide
agaaguccaggcagagaca

SEQ ID NO: 3318 - RNA, 19 nt, Artificial Sequence
  Synthetic oligonucleotide
gaaguccaggcagagacaa

SEQ ID NO: 3319 - RNA, 19 nt, Artificial Sequence
  Synthetic oligonucleotide
aaguccaggcagagacaau

SEQ ID NO: 3320 - RNA, 19 nt, Artificial Sequence
  Synthetic oligonucleotide
aguccaggcagagacaaua

SEQ ID NO: 3321 - RNA, 19 nt, Artificial Sequence
  Synthetic oligonucleotide
uccaggcagagacaauaaa

SEQ ID NO: 3322 - RNA, 19 nt, Artificial Sequence
  Synthetic oligonucleotide
ccaggcagagacaauaaaa

SEQ ID NO: 3323 - RNA, 19 nt, Artificial Sequence
  Synthetic oligonucleotide
caggcagagacaauaaaac

SEQ ID NO: 3324 - RNA, 19 nt, Artificial Sequence
  Synthetic oligonucleotide
aggcagagacaauaaaaca

SEQ ID NO: 3325 - RNA, 19 nt, Artificial Sequence
  Synthetic oligonucleotide
ggcagagacaauaaaacau

SEQ ID NO: 3326 - RNA, 19 nt, Artificial Sequence
  Synthetic oligonucleotide
gcagagacaauaaaacauu

SEQ ID NO: 3327 - RNA, 19 nt, Artificial Sequence
  Synthetic oligonucleotide
cagagacaauaaaacauuc

SEQ ID NO: 3328 - RNA, 19 nt, Artificial Sequence
  Synthetic oligonucleotide
agagacaauaaaacauucc

SEQ ID NO: 3329 - RNA, 19 nt, Artificial Sequence
  Synthetic oligonucleotide
gagacaauaaaacauuccu

SEQ ID NO: 3330 - RNA, 19 nt, Artificial Sequence
  Synthetic oligonucleotide
agacaauaaaacauuccug

SEQ ID NO: 3331 - RNA, 19 nt, Artificial Sequence
  Synthetic oligonucleotide
gacaauaaaacauuccugu

SEQ ID NO: 3332 - RNA, 19 nt, Artificial Sequence
  Synthetic oligonucleotide
acaauaaaacauuccugug

SEQ ID NO: 3333 - RNA, 19 nt, Artificial Sequence
  Synthetic oligonucleotide
caauaaaacauuccuguga

SEQ ID NO: 3334 - RNA, 19 nt, Artificial Sequence
  Synthetic oligonucleotide
uaaaacauuccugugaaag

SEQ ID NO: 3335 - RNA, 19 nt, Artificial Sequence
  Synthetic oligonucleotide
aaaacauuccugugaaagg

SEQ ID NO: 3336 - RNA, 19 nt, Artificial Sequence
  Synthetic oligonucleotide
aaacauuccugugaaaggc

SEQ ID NO: 3337 - RNA, 19 nt, Artificial Sequence
  Synthetic oligonucleotide
aacauuccugugaaaggca

SEQ ID NO: 3338 - RNA, 19 nt, Artificial Sequence
  Synthetic oligonucleotide
acauuccugugaaaggcac

SEQ ID NO: 3339 - RNA, 19 nt, Artificial Sequence
  Synthetic oligonucleotide
cauuccugugaaaggcacu

SEQ ID NO: 3340 - RNA, 19 nt, Artificial Sequence
  Synthetic oligonucleotide
uuccugugaaaggcacuuu

SEQ ID NO: 3341 - RNA, 19 nt, Artificial Sequence
  Synthetic oligonucleotide
uccugugaaaggcacuuuu

SEQ ID NO: 3342 - RNA, 19 nt, Artificial Sequence
  Synthetic oligonucleotide
ccugugaaaggcacuuuuc

SEQ ID NO: 3343 - RNA, 19 nt, Artificial Sequence
  Synthetic oligonucleotide
cugugaaaggcacuuuuca

SEQ ID NO: 3344 - RNA, 19 nt, Artificial Sequence
  Synthetic oligonucleotide
ugugaaaggcacuuuucau

SEQ ID NO: 3345 - RNA, 19 nt, Artificial Sequence
  Synthetic oligonucleotide
gugaaaggcacuuuucauu

SEQ ID NO: 3346 - RNA, 19 nt, Artificial Sequence
  Synthetic oligonucleotide
ugaaaggcacuuuucauuc

SEQ ID NO: 3347 - RNA, 19 nt, Artificial Sequence
  Synthetic oligonucleotide
gaaaggcacuuuucauucc

SEQ ID NO: 3348 - RNA, 19 nt, Artificial Sequence
  Synthetic oligonucleotide
aaaggcacuuuucauucca

SEQ ID NO: 3349 - RNA, 19 nt, Artificial Sequence
  Synthetic oligonucleotide
aaggcacuuuucauuccac

SEQ ID NO: 3350 - RNA, 19 nt, Artificial Sequence
  Synthetic oligonucleotide
aggcacuuuucauuccacu

SEQ ID NO: 3351 - RNA, 19 nt, Artificial Sequence
  Synthetic oligonucleotide
ggcacuuuucauuccacuu

SEQ ID NO: 3352 - RNA, 19 nt, Artificial Sequence
  Synthetic oligonucleotide
gcacuuuucauuccacuuu

SEQ ID NO: 3353 - RNA, 19 nt, Artificial Sequence
  Synthetic oligonucleotide
cacuuuucauuccacuuua

SEQ ID NO: 3354 - RNA, 19 nt, Artificial Sequence
  Synthetic oligonucleotide
acuuuucauuccacuuuaa

SEQ ID NO: 3355 - RNA, 19 nt, Artificial Sequence
  Synthetic oligonucleotide
cuuuucauuccacuuuaac

SEQ ID NO: 3356 - RNA, 19 nt, Artificial Sequence
  Synthetic oligonucleotide
uuuucauuccacuuuaacu

SEQ ID NO: 3357 - RNA, 19 nt, Artificial Sequence
  Synthetic oligonucleotide
uuucauuccacuuuaacuu

SEQ ID NO: 3358 - RNA, 19 nt, Artificial Sequence
  Synthetic oligonucleotide
uucauuccacuuuaacuug

SEQ ID NO: 3359 - RNA, 19 nt, Artificial Sequence
  Synthetic oligonucleotide
ucauuccacuuuaacuuga

SEQ ID NO: 3360 - RNA, 19 nt, Artificial Sequence
  Synthetic oligonucleotide
cauuccacuuuaacuugau

SEQ ID NO: 3361 - RNA, 19 nt, Artificial Sequence
  Synthetic oligonucleotide
auuccacuuuaacuugauu

SEQ ID NO: 3362 - RNA, 19 nt, Artificial Sequence
  Synthetic oligonucleotide
uuccacuuuaacuugauuu

SEQ ID NO: 3363 - RNA, 19 nt, Artificial Sequence
  Synthetic oligonucleotide
uccacuuuaacuugauuuu

SEQ ID NO: 3364 - RNA, 19 nt, Artificial Sequence
  Synthetic oligonucleotide
ccacuuuaacuugauuuuu

SEQ ID NO: 3365 - RNA, 19 nt, Artificial Sequence
  Synthetic oligonucleotide
cacuuuaacuugauuuuuu

SEQ ID NO: 3366 - RNA, 19 nt, Artificial Sequence
  Synthetic oligonucleotide
acuuuaacuugauuuuuua

SEQ ID NO: 3367 - RNA, 19 nt, Artificial Sequence
  Synthetic oligonucleotide
cuuuaacuugauuuuuuaa

SEQ ID NO: 3368 - RNA, 19 nt, Artificial Sequence
  Synthetic oligonucleotide
uuuaacuugauuuuuuaaa

SEQ ID NO: 3369 - RNA, 19 nt, Artificial Sequence
  Synthetic oligonucleotide
uuaacuugauuuuuuaaau

SEQ ID NO: 3370 - RNA, 19 nt, Artificial Sequence
  Synthetic oligonucleotide
uaacuugauuuuuuaaauu

SEQ ID NO: 3371 - RNA, 19 nt, Artificial Sequence
  Synthetic oligonucleotide
aacuugauuuuuuaaauuc

SEQ ID NO: 3372 - RNA, 19 nt, Artificial Sequence
  Synthetic oligonucleotide
acuugauuuuuuaaauucc

SEQ ID NO: 3373 - RNA, 19 nt, Artificial Sequence
  Synthetic oligonucleotide
cuugauuuuuuaaauuccc

SEQ ID NO: 3374 - RNA, 19 nt, Artificial Sequence
  Synthetic oligonucleotide
uugauuuuuuaaauucccu

SEQ ID NO: 3375 - RNA, 19 nt, Artificial Sequence
  Synthetic oligonucleotide
ugauuuuuuaaauucccuu

SEQ ID NO: 3376 - RNA, 19 nt, Artificial Sequence
  Synthetic oligonucleotide
auuuuuuaaauucccuuau

SEQ ID NO: 3377 - RNA, 19 nt, Artificial Sequence
  Synthetic oligonucleotide
uuaaauucccuuauugucc

SEQ ID NO: 3378 - RNA, 19 nt, Artificial Sequence
  Synthetic oligonucleotide
uaaauucccuuauuguccc

SEQ ID NO: 3379 - RNA, 19 nt, Artificial Sequence
  Synthetic oligonucleotide
auucccuuauugucccuuc

SEQ ID NO: 3380 - RNA, 19 nt, Artificial Sequence
  Synthetic oligonucleotide
aaaaaaagagaaucaaaau

SEQ ID NO: 3381 - RNA, 19 nt, Artificial Sequence
  Synthetic oligonucleotide
aaaaaagagaaucaaaauu

SEQ ID NO: 3382 - RNA, 19 nt, Artificial Sequence
  Synthetic oligonucleotide
aaaaagagaaucaaaauuu

SEQ ID NO: 3383 - RNA, 19 nt, Artificial Sequence
  Synthetic oligonucleotide
aaaagagaaucaaaauuuu

SEQ ID NO: 3384 - RNA, 19 nt, Artificial Sequence
  Synthetic oligonucleotide
aaagagaaucaaaauuuua

SEQ ID NO: 3385 - RNA, 19 nt, Artificial Sequence
  Synthetic oligonucleotide
aagagaaucaaaauuuuac

SEQ ID NO: 3386 - RNA, 19 nt, Artificial Sequence
  Synthetic oligonucleotide
agagaaucaaaauuuuaca

SEQ ID NO: 3387 - RNA, 19 nt, Artificial Sequence
  Synthetic oligonucleotide
gagaaucaaaauuuuacaa

SEQ ID NO: 3388 - RNA, 19 nt, Artificial Sequence
  Synthetic oligonucleotide
agaaucaaaauuuuacaaa

SEQ ID NO: 3389 - RNA, 19 nt, Artificial Sequence
  Synthetic oligonucleotide
gaaucaaaauuuuacaaag

SEQ ID NO: 3390 - RNA, 19 nt, Artificial Sequence
  Synthetic oligonucleotide
aaucaaaauuuuacaaaga

SEQ ID NO: 3391 - RNA, 19 nt, Artificial Sequence
  Synthetic oligonucleotide
aucaaaauuuuacaaagaa

SEQ ID NO: 3392 - RNA, 19 nt, Artificial Sequence
  Synthetic oligonucleotide
ucaaaauuuuacaaagaau

SEQ ID NO: 3393 - RNA, 19 nt, Artificial Sequence
  Synthetic oligonucleotide
caaaauuuuacaaagaauc

SEQ ID NO: 3394 - RNA, 19 nt, Artificial Sequence
  Synthetic oligonucleotide
aaaauuuuacaaagaauca

SEQ ID NO: 3395 - RNA, 19 nt, Artificial Sequence
  Synthetic oligonucleotide
aauuuuacaaagaaucaaa

SEQ ID NO: 3396 - RNA, 19 nt, Artificial Sequence
  Synthetic oligonucleotide
auuuuacaaagaaucaaag

SEQ ID NO: 3397 - RNA, 19 nt, Artificial Sequence
  Synthetic oligonucleotide
uuuuacaaagaaucaaagg

SEQ ID NO: 3398 - RNA, 19 nt, Artificial Sequence
  Synthetic oligonucleotide
uuuacaaagaaucaaagga

SEQ ID NO: 3399 - RNA, 19 nt, Artificial Sequence
  Synthetic oligonucleotide
uuacaaagaaucaaaggaa

SEQ ID NO: 3400 - RNA, 19 nt, Artificial Sequence
  Synthetic oligonucleotide
uacaaagaaucaaaggaau

SEQ ID NO: 3401 - RNA, 19 nt, Artificial Sequence
  Synthetic oligonucleotide
acaaagaaucaaaggaauu

SEQ ID NO: 3402 - RNA, 19 nt, Artificial Sequence
  Synthetic oligonucleotide
caaagaaucaaaggaauuc

SEQ ID NO: 3403 - RNA, 19 nt, Artificial Sequence
  Synthetic oligonucleotide
aaagaaucaaaggaauucu

SEQ ID NO: 3404 - RNA, 19 nt, Artificial Sequence
  Synthetic oligonucleotide
aagaaucaaaggaauucua

SEQ ID NO: 3405 - RNA, 19 nt, Artificial Sequence
  Synthetic oligonucleotide
agaaucaaaggaauucuag

SEQ ID NO: 3406 - RNA, 19 nt, Artificial Sequence
  Synthetic oligonucleotide
gaaucaaaggaauucuaga

SEQ ID NO: 3407 - RNA, 19 nt, Artificial Sequence
  Synthetic oligonucleotide
aaucaaaggaauucuagaa

SEQ ID NO: 3408 - RNA, 19 nt, Artificial Sequence
  Synthetic oligonucleotide
aucaaaggaauucuagaaa

SEQ ID NO: 3409 - RNA, 19 nt, Artificial Sequence
  Synthetic oligonucleotide
ucaaaggaauucuagaaag

SEQ ID NO: 3410 - RNA, 19 nt, Artificial Sequence
  Synthetic oligonucleotide
cuaggagagauccaaauuu

SEQ ID NO: 3411 - RNA, 19 nt, Artificial Sequence
  Synthetic oligonucleotide
uaggagagauccaaauuuc

SEQ ID NO: 3412 - RNA, 19 nt, Artificial Sequence
  Synthetic oligonucleotide
gagagauccaaauuuccau

SEQ ID NO: 3413 - RNA, 19 nt, Artificial Sequence
  Synthetic oligonucleotide
agagauccaaauuuccauu

SEQ ID NO: 3414 - RNA, 19 nt, Artificial Sequence
  Synthetic oligonucleotide
gagauccaaauuuccauug

SEQ ID NO: 3415 - RNA, 19 nt, Artificial Sequence
  Synthetic oligonucleotide
agauccaaauuuccauugu

SEQ ID NO: 3416 - RNA, 19 nt, Artificial Sequence
  Synthetic oligonucleotide
gauccaaauuuccauuguc

SEQ ID NO: 3417 - RNA, 19 nt, Artificial Sequence
  Synthetic oligonucleotide
auccaaauuuccauugucu

SEQ ID NO: 3418 - RNA, 19 nt, Artificial Sequence
  Synthetic oligonucleotide
uccaaauuuccauugucuu

SEQ ID NO: 3419 - RNA, 19 nt, Artificial Sequence
  Synthetic oligonucleotide
ccaaauuuccauugucuug

SEQ ID NO: 3420 - RNA, 19 nt, Artificial Sequence
  Synthetic oligonucleotide
caaauuuccauugucuugc

SEQ ID NO: 3421 - RNA, 19 nt, Artificial Sequence
  Synthetic oligonucleotide
aaauuuccauugucuugca

SEQ ID NO: 3422 - RNA, 19 nt, Artificial Sequence
  Synthetic oligonucleotide
aauuuccauugucuugcaa

SEQ ID NO: 3423 - RNA, 19 nt, Artificial Sequence
  Synthetic oligonucleotide
auuuccauugucuugcaag

SEQ ID NO: 3424 - RNA, 19 nt, Artificial Sequence
  Synthetic oligonucleotide
uuuccauugucuugcaagc

SEQ ID NO: 3425 - RNA, 19 nt, Artificial Sequence
  Synthetic oligonucleotide
uuccauugucuugcaagca

SEQ ID NO: 3426 - RNA, 19 nt, Artificial Sequence
  Synthetic oligonucleotide
uccauugucuugcaagcaa

SEQ ID NO: 3427 - RNA, 19 nt, Artificial Sequence
  Synthetic oligonucleotide
ccauugucuugcaagcaaa

SEQ ID NO: 3428 - RNA, 19 nt, Artificial Sequence
  Synthetic oligonucleotide
cauugucuugcaagcaaag

SEQ ID NO: 3429 - RNA, 19 nt, Artificial Sequence
  Synthetic oligonucleotide
auugucuugcaagcaaagc

SEQ ID NO: 3430 - RNA, 19 nt, Artificial Sequence
  Synthetic oligonucleotide
uugucuugcaagcaaagca

SEQ ID NO: 3431 - RNA, 19 nt, Artificial Sequence
  Synthetic oligonucleotide
ugucuugcaagcaaagcac

SEQ ID NO: 3432 - RNA, 19 nt, Artificial Sequence
  Synthetic oligonucleotide
gucuugcaagcaaagcacg

SEQ ID NO: 3433 - RNA, 19 nt, Artificial Sequence
  Synthetic oligonucleotide
ucuugcaagcaaagcacgu

SEQ ID NO: 3434 - RNA, 19 nt, Artificial Sequence
  Synthetic oligonucleotide
cuugcaagcaaagcacgua

SEQ ID NO: 3435 - RNA, 19 nt, Artificial Sequence
  Synthetic oligonucleotide
uugcaagcaaagcacguau

SEQ ID NO: 3436 - RNA, 19 nt, Artificial Sequence
  Synthetic oligonucleotide
ugcaagcaaagcacguauu

SEQ ID NO: 3437 - RNA, 19 nt, Artificial Sequence
  Synthetic oligonucleotide
gcaagcaaagcacguauua

SEQ ID NO: 3438 - RNA, 19 nt, Artificial Sequence
  Synthetic oligonucleotide
caagcaaagcacguauuaa

SEQ ID NO: 3439 - RNA, 19 nt, Artificial Sequence
  Synthetic oligonucleotide
aagcaaagcacguauuaaa

SEQ ID NO: 3440 - RNA, 19 nt, Artificial Sequence
  Synthetic oligonucleotide
agcaaagcacguauuaaau

SEQ ID NO: 3441 - RNA, 19 nt, Artificial Sequence
  Synthetic oligonucleotide
gcaaagcacguauuaaaua

SEQ ID NO: 3442 - RNA, 19 nt, Artificial Sequence
  Synthetic oligonucleotide
caaagcacguauuaaauau

SEQ ID NO: 3443 - RNA, 19 nt, Artificial Sequence
  Synthetic oligonucleotide
aaagcacguauuaaauaug

SEQ ID NO: 3444 - RNA, 19 nt, Artificial Sequence
  Synthetic oligonucleotide
aagcacguauuaaauauga

SEQ ID NO: 3445 - RNA, 19 nt, Artificial Sequence
  Synthetic oligonucleotide
agcacguauuaaauaugau

SEQ ID NO: 3446 - RNA, 19 nt, Artificial Sequence
  Synthetic oligonucleotide
cacguauuaaauaugaucu

SEQ ID NO: 3447 - RNA, 19 nt, Artificial Sequence
  Synthetic oligonucleotide
acguauuaaauaugaucug

SEQ ID NO: 3448 - RNA, 19 nt, Artificial Sequence
  Synthetic oligonucleotide
guauuaaauaugaucugca

SEQ ID NO: 3449 - RNA, 19 nt, Artificial Sequence
  Synthetic oligonucleotide
uauuaaauaugaucugcag

SEQ ID NO: 3450 - RNA, 19 nt, Artificial Sequence
  Synthetic oligonucleotide
auuaaauaugaucugcagc

SEQ ID NO: 3451 - RNA, 19 nt, Artificial Sequence
  Synthetic oligonucleotide
uuaaauaugaucugcagcc

SEQ ID NO: 3452 - RNA, 19 nt, Artificial Sequence
  Synthetic oligonucleotide
uaaauaugaucugcagcca

SEQ ID NO: 3453 - RNA, 19 nt, Artificial Sequence
  Synthetic oligonucleotide
aaauaugaucugcagccau

SEQ ID NO: 3454 - RNA, 19 nt, Artificial Sequence
  Synthetic oligonucleotide
aauaugaucugcagccauu

SEQ ID NO: 3455 - RNA, 19 nt, Artificial Sequence
  Synthetic oligonucleotide
auaugaucugcagccauua

SEQ ID NO: 3456 - RNA, 19 nt, Artificial Sequence
  Synthetic oligonucleotide
uaugaucugcagccauuaa

SEQ ID NO: 3457 - RNA, 21 nt, Artificial Sequence
  Synthetic oligonucleotide
ccaucagaggacacuuggauu

SEQ ID NO: 3458 - RNA, 27 nt, Artificial Sequence
  Synthetic oligonucleotide
aauccaaguguccucugauggucaaca

SEQ ID NO: 3459 - RNA, 21 nt, Artificial Sequence
  Synthetic oligonucleotide
aauccaaguguccucugauaa

SEQ ID NO: 3460 - DNA, 25 bp, Artificial Sequence
  Synthetic oligonucleotide
uccaaguguccucugaugaucaaag

SEQ ID NO: 3461 - DNA, 25 bp, Artificial Sequence
  Synthetic oligonucleotide
uccaaguguccucugauggacaaag

SEQ ID NO: 3462 - DNA, 25 bp, Artificial Sequence
  Synthetic oligonucleotide
uccaaguguccucugaugguaaaag

SEQ ID NO: 3463 - DNA, 25 bp, Artificial Sequence
  Synthetic oligonucleotide
uccaaguguccucugauggucgaag

SEQ ID NO: 3464 - DNA, 25 bp, Artificial Sequence
  Synthetic oligonucleotide
uccaaguguccucugauggucauag

SEQ ID NO: 3465 - DNA, 25 bp, Artificial Sequence
  Synthetic oligonucleotide
uccaaguguccucugauggucaagg

SEQ ID NO: 3466 - DNA, 25 bp, Artificial Sequence
  Synthetic oligonucleotide
uccaaguguccucugauggucaaaa

SEQ ID NO: 3467 - RNA, 27 nt, Artificial Sequence
  Synthetic oligonucleotide
uuuugaccaucagaggacacuuggauu

SEQ ID NO: 3468 - RNA, 27 nt, Artificial Sequence
  Synthetic oligonucleotide
ccuugaccaucagaggacacuuggauu

SEQ ID NO: 3469 - RNA, 27 nt, Artificial Sequence
  Synthetic oligonucleotide
cuaugaccaucagaggacacuuggauu

SEQ ID NO: 3470 - RNA, 27 nt, Artificial Sequence
  Synthetic oligonucleotide
cuucgaccaucagaggacacuuggauu

SEQ ID NO: 3471 - RNA, 27 nt, Artificial Sequence
  Synthetic oligonucleotide
cuuuuaccaucagaggacacuuggauu

SEQ ID NO: 3472 - RNA, 27 nt, Artificial Sequence
  Synthetic oligonucleotide
cuuuguccaucagaggacacuuggauu

SEQ ID NO: 3473 - RNA, 27 nt, Artificial Sequence
  Synthetic oligonucleotide
cuuugaucaucagaggacacuuggauu

SEQ ID NO: 3474 - RNA, 25 nt, Artificial Sequence
  Synthetic oligonucleotide
  misc_feature (19)..(25): n is a, c, g, or u
agacaccaaaucuuacugnnnnnnn

SEQ ID NO: 3475 - RNA, 27 nt, Artificial Sequence
  Synthetic oligonucleotide
  misc_feature (1)..(7): n is a, c, g, or u
nnnnnnncaguaagauuuggugucuau

SEQ ID NO: 3476 - RNA, 27 nt, Artificial Sequence
  Synthetic oligonucleotide
  misc_feature (21)..(27): n is a, c, g, or u
auagacaccaaaucuuacugnnnnnnn

SEQ ID NO: 3477 - RNA, 31 nt, Artificial Sequence
  Synthetic oligonucleotide
aauccaaguguccucugauggucaaaguucu

SEQ ID NO: 3478 - DNA, 37 bp, Artificial Sequence
  Synthetic oligonucleotide
  misc_feature (1)..(27): n is a, c, g, t or u
nnnnnnnnnnnnnnnnnnnnnnnnnnnuagcuaucgt

SEQ ID NO: 3479 - DNA, 56 bp, Artificial Sequence
  Synthetic oligonucleotide
  misc_feature (1)..(19): n is a, c, g, t or u
  misc_feature (36)..(56): n is a, c, g, t or u
nnnnnnnnnnnnnnnnnnngcagccgaaaggcugcnnnnnnnnnnnnnnnnnnnnn

We claim:

1. A double stranded nucleic acid (dsNA) comprising first and second nucleic acid strands comprising RNA, wherein said first strand is 15-66 nucleotides in length and said second strand of said dsNA is 19-66 nucleotides in length, wherein said second oligonucleotide strand is complementary to a target transthyretin mRNA sequence selected from SEQ ID NOs: 1962, 1964, 1977, 1979, 1981, 1982, 1992, 1994 and 2007 along at least 15 nucleotides of said second oligonucleotide strand length to reduce transthyretin target mRNA expression when said double stranded nucleic acid is introduced into a mammalian cell, wherein said second strand comprises a sequence selected from the group consisting of SEQ ID NOs: 426, 428, 441, 443, 445, 446, 456, 458 and 471, wherein said dsNA comprises a modified nucleotide.

2. The nucleic acid of claim 1, wherein said oligonucleotide strand is 19-35 nucleotides in length.

3. The dsNA of claim 1 comprising a duplex region selected from the group consisting of at least 25 base pairs; 19-21 base pairs and 21-25 base pairs.

4. The dsNA of claim 1, wherein the 3' end of the first strand and the 5' end of the second strand are joined by a polynucleotide sequence comprising ribonucleotides, deoxyribonucleotides or both, optionally wherein the polynucleotide sequence comprises a tetraloop sequence.

5. The dsNA of claim 1, wherein said first strand comprises a sequence selected from the group consisting of SEQ ID NOs: 42, 44, 57, 59, 61, 62, 72, 74 and 87.

6. A double stranded nucleic acid (dsNA) comprising first and second nucleic acid strands comprising RNA, wherein said first strand is 15-66 nucleotides in length and said second strand of said dsNA is 19-66 nucleotides in length, wherein said second oligonucleotide strand is complementary to a target transthyretin mRNA sequence selected from SEQ ID NOs: 1962, 1964, 1977, 1979, 1981, 1982, 1992, 1994 and 2007 along at least 15 nucleotides of said second oligonucleotide strand length to reduce transthyretin target mRNA expression when said double stranded nucleic acid is introduced into a mammalian cell and wherein said dsNA further comprises a pair of first strand/second strand sequences selected from the group consisting of TTR-156, TTR-158, TTR-240, TTR-242, TTR-244, TTR-245, TTR-255, TTR-257 and TTR-357 of Table 2, wherein said dsNA comprises a modified nucleotide.

7. The dsNA of claim 1, wherein said modified nucleotide residue is selected from the group consisting of 2'-O-methyl, 2'-methoxyethoxy, 2'-fluoro, 2'-allyl, 2'-O, 4'-thio, 4'-CH2-O-2'-bridge, 4'-(CH2)2-O-2'-bridge, 2'-LNA, 2'-amino and 2'-O—(N-methlycarbamate).

8. The dsNA of claim 1 comprising a modified nucleotide selected from the group consisting of a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, and a locked nucleic acid.

9. The dsNA of claim 1 comprising a phosphate backbone modification selected from the group consisting of a phosphonate, a phosphorothioate and a phosphotriester.

10. The dsNA of claim 1 comprising a modification selected from the group consisting of a morpholino nucleic acid and a peptide nucleic acid (PNA).

11. The dsNA of claim 1, wherein said dsNA is attached to a dynamic polyconjugate (DPC).

12. The dsNA of claim 1, wherein said dsNA is attached to a moiety selected from the group consisting of a GalNAc moiety, a cholesterol and a cholesterol targeting ligand.

13. A formulation comprising the dsNA of claim 1, wherein said dsNA is present in an amount effective to reduce target transthyretin mRNA levels when dsNA is introduced into a mammalian cell in vitro by an amount (expressed by %) selected from the group consisting of at least 10%, at least 50% and at least 80-90%.

14. A formulation comprising the dsNA of claim 1, wherein said dsNA is present in an amount effective to reduce target transthyretin mRNA levels when said dsNA is introduced into a cell of a mammalian subject by an amount (expressed by %) selected from the group consisting of at least 10%, at least 50% and at least 80-90%.

15. A mammalian cell containing the dsNA of claim 1.

16. A pharmaceutical composition comprising the dsNA of claim 1 and a pharmaceutically acceptable carrier.

17. A kit comprising the dsNA of claim 1 and instructions for its use.

18. A composition possessing transthyretin inhibitory activity consisting essentially of the dsNA of claim 1.

19. A method for reducing expression of a target transthyretin gene in a mammalian cell comprising contacting a mammalian cell in vitro with the dsNA of claim 1 in an amount sufficient to reduce expression of a target transthyretin mRNA in said cell.

20. A method for reducing expression of a target transthyretin mRNA in a mammal comprising administering the dsNA of claim 1 to a mammal in an amount sufficient to reduce expression of a target transthyretin mRNA in the mammal.

21. The method of claim 20, wherein said dsNA is formulated in a lipid nanoparticle (LNP).

22. A method for treating or preventing a disease or disorder in a subject comprising administering to said subject an amount of the dsNA of claim 1 sufficient to treat or prevent said disease or disorder in said subject.

23. The method of claim 22, wherein said disease or disorder is amyloidosis.

24. The method of claim 22, wherein said subject is human.

* * * * *